United States Patent 11,624,072 (CANOLA WITH HIGH OLEIC ACID) - sequence listing, part 5

SEQ ID NO: 25708 - DNA, 337 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtcggcctcgtcttccactccttcttccacagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25709 - DNA, 315 bp, Artificial
  Mutation in BnaC.FAD2.b introduced by TALE nuclease pair BnFAD2_T02
cctctcctccctcaccctctcacctacttcgcctggcatccctactgggcctgccaagggtgcgtcctaaccggcgtctgggtcatagcccacgagtgcggccaccacgccttcagcgaccaccaatggcggtggcaagcaggcgctggagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25710 - DNA, 351 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacgccgtgggcctcgtcttccactccttcctcctcgtcccttacttctcctggatcgacgccaccattccaacaccggatccctcgagagggatgaagtgttcgtccccaagaagaaatccgacatcaagtggtacggaaagtacctcaacaacccgctaggacgcacggtgatgctaaccgtccagttcactctcggctggcctttgtacttag

SEQ ID NO: 25711 - DNA, 357 bp, Artificial
  Mutation in BnaC.FAD2.b introduced by TALE nuclease pair BnFAD2_T02
cctctcctccctcaccctctcccttacctcgcctggcccctctactggtcctgccaaggctgcgtcctaacgggcctctgggtcatcgcccacgaatgcgtccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccggtaggacgcacggtgctgctacccgtccagttcacgctcggctggcctttgtacttag

SEQ ID NO: 25712 - DNA, 393 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacatgttctttcctgcgttatcccctgattctgtggatatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25713 - DNA, 357 bp, Artificial
  Mutation in BnaC.FAD2.b introduced by TALE nuclease pair BnFAD2_T02
cctctcctccctcaccctctcccttacctcgcctggcacatctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaggccatcgacgccaccattccaacaccggatccctcgagagggatgaagtgttcgtccccaagaagaaatccgacatcaagtggtacggaaagtacctcaacaacccgctaggacgcacggggatgctaaccttccaggtcacgcgcggctggcctgtgtacttag

SEQ ID NO: 25714 - DNA, 352 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgggggcctcgtcttccactccttcctcctcgtcccttacttctgaagccatcgacgccaccagtccaacaccggatccctcgagagggatgaagtgttcgtcccaaagaagaagtcagacatcaagtggtacggcaagtacctcaacaaccctttgggacgcaccgtgatgttaacggttcagttcactctcggctggcctttgtacttag

SEQ ID NO: 25715 - DNA, 359 bp, Artificial
  Mutation in BnaC.FAD2.b introduced by TALE nuclease pair BnFAD2_T02
cctctcctccctcaccctctctcctacttcgcctggcctctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagaagccatcgacgccaccattccaacaccggatccctcgagagggatgaagtgttcgtccccaagaagaaatccgacatcaagtggtacggaaagtacctcaacaacccgcgaggacgcacggtgatgctaaccgtccagttcacgctcggctggcctttgtacttag

SEQ ID NO: 25716 - DNA, 357 bp, Artificial
  Mutation in BnaC.FAD2.b introduced by TALE nuclease pair BnFAD2_T02
cctctcctccctcaccctctcccttacctcgcctggcccctctcctgggcctgccaaggatgcgtcctaacgggcctctgggtcatcgcccacgaatgcggccaccacgccttcagcgaccaccagtggctgcacgacgccgtgggcctcgtcttccactccttcctcctcgtcccttacttctcctggaaagccatcgacgccaccattccaacaccggatccctcgagagggatgaagcgttcgtccccaagaagaaaccccacatcaagtggtacggaaagtacctcaacaacccgctaggacgcacggtgagtctaaccgtccggttcacgctcggctggcctttgtacttag

SEQ ID NO: 25717 - DNA, 436 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagcggtggtttttttgtttgcaagcagcagattacgcgcagaaaaaaaggatctcaagtgaccttaggcgacttttgaacagccagcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25718 - DNA, 362 bp, Artificial
  Mutation in BnaC.FAD2.b introduced by TALE nuclease pair BnFAD2_T02
cctctcctccctcaccctctctcctacttcgcctggcctctctcctgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagttacagccatcgacgccaccattccaacaccggatccctcgagagggatgaagtgttcgtccccaagaagaaatccgacatcaagtggtacggaaagtacctcaacaacccgctaggacgcacggtgatgcttaccgtccagttcacgctcggctggcctttgtacttag

SEQ ID NO: 25719 - DNA, 413 bp, Artificial
  Mutation in BnaC.FAD2.b introduced by TALE nuclease pair BnFAD2_T02
cctctcctccctcaccctctcacttacctcgcctggcccccctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggacaggcccacggcttgaccccccagcaggtggtggccatcgccagcaatggcggtggcagccatcgacgccaccattccaacaccggatccctcgagagggatgaagtgttcgtccccaagaagaaatccgacatcaagtggtacggaaagtacctcaacaacccgctaggacgcacggtgatgctaaccttccagttcacgcgcggctggcctgtgtacttag

SEQ ID NO: 25720 - DNA, 356 bp, Artificial
  Mutation in BnaC.FAD2.b introduced by TALE nuclease pair BnFAD2_T02
cctctcctccctcaccctctctcctacttcgcctggcctctctactgggcctgccagggctgcgtcctaaccggcgtctgagtcatagcccacgagtgcggccaccacgccttcagcgaccaccagtggctggacgacgccgtgggcctcgtcttccactccttcctcctcgtcccttacttctcctggaagccatcgacgccaccattccaacaccggatccctcgagagggatgaagtgttcgtccccaagaagaaatccgacatcaagtggtacggaaagtacctcaacaacccgctaggacgcacggtgatgctaaccgtccaggtcacgctcggctggcctttgtacttag

SEQ ID NO: 25721 - DNA, 273 bp, Artificial
  Mutation in BnaC.FAD2.b introduced by TALE nuclease pair BnFAD2_T02
cctctcctccctcaccctctgacttacctcgcctggcccctctcctgggcctgccaaggctgcgtcctaacgggcctctgggtcatcgcccacaaatgcggccaccacgccatcgacgccaccattccaacaccggatcccccgagagggatgaagtgttcgtccccaagaagaagtcagacatcaagtggtacggcaagtacctcaacaaccctttgggacgcaccgggatgttaacggttcagttcactcgcggccggcctgtgtacttag

SEQ ID NO: 25722 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgttcgtccccaagaagaagtcagacatcaagtggtacggcaagtacctcaacaaccctttgggacgcaccgggatgttaacgtttcagttcactcgctgctggcctttgtacttag

SEQ ID NO: 25723 - DNA, 274 bp, Artificial
  Mutation in BnaC.FAD2.b introduced by TALE nuclease pair BnFAD2_T02
cctctcctccctcaccctctctcctacttcgcctggcctctctactgggcctgccaagggtgcgtcctaaccggcgtctgggtcatagcccacgagtgcggccaccacgccttcagcgaccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25724 - DNA, 357 bp, Artificial
  Mutation in BnaC.FAD2.b introduced by TALE nuclease pair BnFAD2_T02
cctctcctccctcaacctctctcttacctcgcctggcccctctactgggcctgccaaggctgcgtcctaacgggcctctgggtcgtcgcccacgaatgcggccaccacgccttcagcgaccaccagtggctggacgacgccgtgggcctcgtcttccactccttcctcctcgtcccttacttctcctggaaagccatcgacgccaccattccaacaccggatccctcgagagggatgaagtgtacgtccccaagaagaaatccgacatcaagtggtacggaaagtacctcaacaacccgctaggacgcacggtgatgctaaccgtccagttcacgctcggctggcctgtgtacttag

SEQ ID NO: 25725 - DNA, 355 bp, Artificial
  Mutation in BnaC.FAD2.b introduced by TALE nuclease pair BnFAD2_T02
cctctcctccctcaccctctcccttacctcgcctggcccctctcctgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaccatcgacgccaccattccaacaccagatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25726 - DNA, 353 bp, Artificial
  Mutation in BnaC.FAD2.b introduced by TALE nuclease pair BnFAD2_T02
cctctcctccctcaccctctctcctacttcgcctggcctctctactgggcctcccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggccatcgacgccaccattccaacaccggatccctcgagagggatgaagtgttcgtccccaagaagaaagccgacatcaagtggtccggaaagtacctcaacaccccgctaggacgcacggggatgctaaccgtccagttcacgctcggctggccttggtacttag

SEQ ID NO: 25727 - DNA, 350 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctcatcgacgccaccattccaacaccggatccctcgagagggatgaagtgttcgtccccaagaagaaatccgacatcaagtggtacggcaagtacctcaacaaccctttgggacgcaccgtgatgttaacggttcagttcactctcggctggcctttgtacttag

SEQ ID NO: 25728 - DNA, 357 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaaagccatcgacgccaccattccaacactggctccctcgagagggatgaagtgttcgtccccaagaagaaatccgacatcaagtggtacggaaagtacctcaacaacccgctaggacgcacggtgatgctaaccgtccagttcacgctcggctggcctgtgtacttag

SEQ ID NO: 25729 - DNA, 349 bp, Artificial
  Mutation in BnaC.FAD2.b introduced by TALE nuclease pair BnFAD2_T02
cctctcctccctcaccctctcacttacctcgcctggcccgtctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctgtcgacgccaccattccaacaccggatccctcgagagggatgaagtgttcgtccccaagaagaaatccgacatcaagtggtacggaaagtacctcaacaacccgctagggcgcacggtgatgctaaccgtccagttcacgctcggctggcctttgtacttag

SEQ ID NO: 25730 - DNA, 324 bp, Artificial
  Mutation in BnaC.FAD2.b introduced by TALE nuclease pair BnFAD2_T02
cctctcctccctcaccctctaacttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccatcgacgccaccattccaacaccggatccctcgagagggatgaagtgttcgtccccaagaagaagtcagacatcaagtggtacggcaagtacctcaacaaccctttgggacgcaccgtgatgttaacggttcagttcactctcggctggcctttgtacttag

SEQ ID NO: 25731 - DNA, 273 bp, Artificial
  Mutation in BnaC.FAD2.b introduced by TALE nuclease pair BnFAD2_T02
cctctcctccctcaccctctcccttacctagcctggcccctctactgggcctgccaaggctgcgtcctaacgggcctctgggtcatcgcccacaaatgcggccaccacgccatcgacgccaccattccaacaccggatccctcgagagggatgaagtgttcgtccccaagaagaaatccgacatcaagtggtacggaaagtgcctcaacaacccgctaggacgcacggtgatgctaaccgtccagttcacgctcggcgggcctttgtacttag

SEQ ID NO: 25732 - DNA, 337 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaccgggcctctgggtcatcgcccacgaatgcggccaccacgccttcagcgaccaccagtggctggacgacgccgtgggcctcgtcttccactccttcttccacagccatcgacgccaccattccaacactggctccctcgagagagacgaagtgtttgtccccaagaagaaatccgacatcaagtggtacggaaagtacctcaacaacccgctaggacgcacggtgatgctatccgtccagttcacgcgcgtctggcctgtgtacttag

SEQ ID NO: 25733 - DNA, 357 bp, Artificial
  Mutation in BnaC.FAD2.b introduced by TALE nuclease pair BnFAD2_T02
cctctcctccctcaccctctcccttacctcgcctggcctctctactgggcctgccagggctgcgtcctaaccggcgtctgggtcatagcccacgagtgcggccaccacgccttcagcgactaccagtggcttgacgacaccgtcggtctcatcttccactccttcctcctcgtcccttacttctcctggaaagccatcgacgccaccattccaacaccggatccctcgagagggatgaagtgttcgtccccaagaagaaatccgacatcaagtggtacggaaagtacctcaacaacccgctaggacgcacggtgatgctaaccgtccagttcacgctcggctggcctttgtacttag

SEQ ID NO: 25734 - DNA, 359 bp, Artificial
  Mutation in BnaC.FAD2.b introduced by TALE nuclease pair BnFAD2_T02
cctctcctccctcaccctctcccttacctcgcctggcccctctactgggcctgccaaggctgcgtcctaacgggcctctgggtcatctcccacgaatgcggccaccacgccttcagcgaccaccagtggctggacgacgccgtgggcctcgtcttccactccttcctcctcgtcccttacttctcctggaagcagccatcgacgccaccattccaacaccggatccctcgagagggatgaagtgttcgtccccaagaagaaatccgacatcaagtggtacggaaaggacctcaacaacccgctagagcgcacggtgatgctaaccgtccaggtcacgctcgggtggcatgtgtacttag

SEQ ID NO: 25735 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25736 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgagtgcggccaccacgccttcagcgactac

SEQ ID NO: 25737 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcataagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25738 - DNA, 346 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25739 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25740 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 25741 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 25742 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggagaactcaagaaagcaatcccaccgcactgtttcaaacgctcgatccctctctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25743 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25744 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25745 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25746 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25747 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcacgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25748 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25749 - DNA, 357 bp, Artificial
  Mutation in BnaA.FAD2.a introduced by TALE nuclease pair BnFAD2_T03
caggatccatgggtgcaggtggaagaatgcaagtggcgcgtccctccaaaaagtctgaaaccgacaacatcaagcgcgtaccctgcgagacaccgccgtgcactgtcggtcggagaactcaagaaagcaatcccaccgcactgtttcaaacgctcgatccctcgctctttctcctacctcatctgggacatcatcatagcctcctgcttctactacgtcgccaccgcttacttccctctcctccctcaccctctctcctccttcgcctggcctctctactgggcctgcccgggctgcgtcctaaccggcgtctgggtcatagcccacgagtgcggccaccacgccttcagcgactac

SEQ ID NO: 25750 - DNA, 319 bp, Artificial
  Mutation in BnaA.FAD2.a introduced by TALE nuclease pair BnFAD2_T03
caggatccatgggtgcaggtggaataatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25751 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25752 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25753 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25754 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25755 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgcctcaagaaagcaatcccaccgcactgtttcaaacgctcgatccctcgctctttctcctacctcatctgggacatcatcatagcctcctgcttccactacgtcgccaccacttacttccctctcctccctcaccctctctcctacttcgcctggcctctctactgggcctgccagggctgcgtcctaaccggcgtctgggtcatagcccacgagtgcggccaccacgccttcagcgaccac

SEQ ID NO: 25756 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 25757 - DNA, 379 bp, Artificial
  Mutation in BnaA.FAD2.a introduced by TALE nuclease pair BnFAD2_T03
caggatccatgggtgcaggtgaagaatgcaagtgtctcctccctccaaaaagtctgaaaccgacaacatcaagcgcgtaccctgcgagacaccgcccttcactgtcgatggccaccacctgctccggggtcaagccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 25758 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 25759 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 25760 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25761 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttacctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25762 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25763 - DNA, 437 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccaacaccatcaagcgcgtaccctgcgagacaccgcccttcactgtctccagcgcctgcttgccaccattattgctggcgctggccaccacctgctggggggtcaagttgagcggggcacccgtcagtgcatgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25764 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactgtttcgaacgctcgatccctcgctctttcttctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25765 - DNA, 308 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25766 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctacggggcctgccaagggtgcgtcctaaccggcgtctgggtcatagcccacgagtgcggccaccacgccttcagcgactac

SEQ ID NO: 25767 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25768 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25769 - DNA, 437 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagactccgcccttcactgtcggactgggcctttcgttttatctgttgtttgtcggtgaacgctctcctgagtaggacaaatccgccgggagcggatttgaacgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25770 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcgggcctggcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25771 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaaccggcgtctgggtcatagcccacgagtgcggccaccacgccttcagcgactac

SEQ ID NO: 25772 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25773 - DNA, 304 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcaatcccaccgcactgtttcaaacgcttgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 25774 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25775 - DNA, 345 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 25776 - DNA, 400 bp, Artificial
  Mutation in BnaA.FAD2.a introduced by TALE nuclease pair BnFAD2_T03
caggatccatgggtgcaggtggaagaatgcaagtctctcctccctccagttcccccggaaccaacaccctcaaacgcgtcccctgcgagacaccacccttcactctcggcaccggcaacagccgctggaccgtctccagcgcctgcttgccaccagagacctcaagaaagcaatcccaccgcactgtttcaaacgctcgatccctcgctctttctcctacctcatctgggacatcatcatagcctcctgcttctactacgccgccaccacgtacttccctctcctccctcaccctctctcctacctcgcctggcctctctactgggcgtgccagggctgcgtcctaaacggcgtatgggtcatatcccccgagtgcggccaccactccttcagcgactac

SEQ ID NO: 25777 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 25778 - DNA, 358 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25779 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 25780 - DNA, 422 bp, Artificial
  Mutation in BnaA.FAD2.a introduced by TALE nuclease pair BnFAD2_T03
caggatccatgggtgcaggtggaagaatgcaagtctctcatccctccaaaaagtctgcaaccgacaacatcaagcgcgtaccctgcgagacaccgcccttcactgtcggctggcgatggccaccacctgctccggggtcaagccgtgggcctggcacagcaccggcaagcaggcgctggagactcaagaaagtaatcccaccgcactgtttcaaacgctcgatccctcgctctttctcctacctcatctgggacatcatcatagcctcctgcttctactacgccgccaccacttccttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25781 - DNA, 354 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25782 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25783 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25784 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 25785 - DNA, 413 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggccatcgccagcaatggcggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25786 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaatggtgcgtcctaaccggcgtctgggtcatagcccacgagtgcggccaccacgccttcagcgactac

SEQ ID NO: 25787 - DNA, 343 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccggcctctctactgggcctgccagggctgcgtcctaaccggcgtctgggtcatagcccacgagtgcggccaccacgccttcagcgactac

SEQ ID NO: 25788 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25789 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25790 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgagtcatcgcccacgaatgcggccaccacgccttcagcgactac

SEQ ID NO: 25791 - DNA, 331 bp, Artificial
  Mutation in BnaA.FAD2.a introduced by TALE nuclease pair BnFAD2_T03
caggatccatgggtgcaggtggaagaatgaaagtgtctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25792 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 25793 - DNA, 380 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgatggccaccacctgctgaggggtcaagccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25794 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 25795 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25796 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 25797 - DNA, 341 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25798 - DNA, 318 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25799 - DNA, 345 bp, Artificial
  Mutation in BnaA.FAD2.a introduced by TALE nuclease pair BnFAD2_T03
caggatccatgggtgcaggtggaagaatgcaagtctctcctccctccaacacctctgaaaccgacaccctcaagcgcgtcccctgcgagacaccgcccttcactgctcaagacagcaatcccaccgcactgcttcaaacgctcgatccctcgctctctctcctacctcatctgtcacatcatcatagcctcctgcttctactccgtcgccaccccttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25800 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgcctgggtcatagcccacgagtgcggccaccacgccttcagcgactac

SEQ ID NO: 25801 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25802 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcataagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25803 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25804 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25805 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 25806 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25807 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 25808 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttcttccaccgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25809 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25810 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 25811 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtactaaccggcgtctgggtcatagcccacgagtgcggccaccacgccttcagcgactac

SEQ ID NO: 25812 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgagtgcggccaccacgccttcagcgactac

SEQ ID NO: 25813 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 25814 - DNA, 326 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25815 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25816 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25817 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 25818 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25819 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagcccgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25820 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcgaccaccacgccttcagcgactac

SEQ ID NO: 25821 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25822 - DNA, 340 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25823 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25824 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25825 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25826 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25827 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25828 - DNA, 393 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25829 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 25830 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctcgggagacctcaagaaagcaatcccacctcactgcttcaaacgctcgatccctcgctctttctcctacctcatctggtacatcatcatagcctcctgcttctactacgtcgccaccacttacttccctctcctccctcaccccctctcctacttcgcctggcctctctactgggcctgccaaggctgcgtcctaacgggcctctgggtcatagcccacgagtgcggccaccatgccttcagcgactac

SEQ ID NO: 25831 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25832 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25833 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagcctggaaccgacaacctcaagcgcgtccccccagcaagaggacaccatcgccagaacccaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcggccaccacgccttcagcgactac

SEQ ID NO: 25834 - DNA, 343 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgccctagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25835 - DNA, 349 bp, Artificial
  Mutation in BnaA.FAD2.a introduced by TALE nuclease pair BnFAD2_T03
caggatccatgggtgcaggtggaagaatgcaagtgtcgcctccgtccaaaaagtctgaaaccgacaacatcaagcgcggacgctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaaccggcgtctcggtcatagcccacgagtgcggccaccacgccttcagcgactac

SEQ ID NO: 25836 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25837 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 25838 - DNA, 409 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgttgcactgacgggtgccccgctcaacttgaccccccagcaggtggtggccatcgccagcaataatggtggcaagcaatcccaccgcactgtttcaaacgctcgatccctcgctctttctcctacctcatctgggacatcatcatagcctcctgcttctactacgtcgccaccacttacttccctctccaccctcaccctctctcctacttcgcctggcctctctactgggcctgccagggctgcgtcctaaccggcgtctgggtcatagcccacgagtgcggccaccacgccttcagcgactac

SEQ ID NO: 25839 - DNA, 348 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25840 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctggcctctctactgggcctgccagggctgcgtcctaacgggcctctgggtcatcgcccacgaatgcggccaccacgccttcagcgactac

SEQ ID NO: 25841 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 25842 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25843 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 25844 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25845 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25846 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgccctaaccggcgtctgggtcatagcccacgagtgcggccaccacgccttcagcgactac

SEQ ID NO: 25847 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgccctaaccggcgtctgggtcatagcccacgagtgcggccaccacgccttcagcgactac

SEQ ID NO: 25848 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcaagcaatcccaccgcactgtttcaaacgctcgatccctcgctctttctcctacctcatctgggacatcatcatagcctactgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25849 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcccggcctctctactgggcctgccagggctgcgtcctaaccggcgtctgggtcatagcccacgagtgcggccaccacgccttcagcgactac

SEQ ID NO: 25850 - DNA, 360 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 25851 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggaactcaagaaagcaatcccaccgcactgtttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25852 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25853 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcctggcctctctacagggcctgccagggctgcgtcctaaccggcgtctgggtcatagcccacgagtgcggccaccacgccttcagcgactac

SEQ ID NO: 25854 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcttggtcatagcccacgagtgcggccaccacgccttcagcgactac

SEQ ID NO: 25855 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25856 - DNA, 350 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25857 - DNA, 417 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgtgggcctggcacagcaccggcaacagccgctggaccgtctccagcgcctgcttgccaccgccattagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25858 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggtctctctactgggcctgccaagggtgcgtcctaaccggcgtctgggtcatagcccacgagtgcggccaccacgccttcagcgactac

SEQ ID NO: 25859 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25860 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25861 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggactgcgtcctaaccggcgtctgggtcatagcccacgagtgcggccaccacgccttcagcgactac

SEQ ID NO: 25862 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25863 - DNA, 334 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 25864 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25865 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25866 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25867 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25868 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25869 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 25870 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25871 - DNA, 316 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 25872 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccagggctgcgtcctaaccggcgtctgggtcatagcccacgagtgcggccaccacgccttcagcgactac

SEQ ID NO: 25873 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgccctctctactgggcctgccagggctgcgtcctaaccggcgtctgggtcatagcccacgagtgcggccaccacgccttcagcgactac

SEQ ID NO: 25874 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25875 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 25876 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagacgtccgaaaccgacaccatcaagcgcgtaccctgcgagacaccgcccttcactctgaactcaagaaagcaatcccaccgcactctttccaacgctcgatccctcgctccttctcctacctcatctgtgacctcatcatagccccctgcttctactaccccgccaccacctacttccctctcctccctcaccctctctcctacttcgcctggcccctctactgggcctgccagggctgcgtcctaaccggcgtctgggtcatagcccacgaatgcggccaccacgccttcagcgactac

SEQ ID NO: 25877 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25878 - DNA, 348 bp, Artificial
  Mutation in BnaA.FAD2.a introduced by TALE nuclease pair BnFAD2_T03
caggaccatgggtgcaggtggaagaatgcaagtctctcctccctccagctcccccggaaccaacaccctcaaacgcgtcccctgcgagacaccaccattcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25879 - DNA, 320 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcaagcaatcccaccgcactgtttcaaacgctcgatccctcgctctttctcctacctcatctgggacatcatcatagcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 25880 - DNA, 391 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaggcgacgaggtggtcgttggtcaacgcggccaacgccgggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25881 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25882 - DNA, 333 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgagcccccgatttagagcttgacggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25883 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25884 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccaagggtgcgtcctaaccggcgtctgggtcatagcccacgagtgcggccaccacgccttcagcgactac

SEQ ID NO: 25885 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 25886 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25887 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 25888 - DNA, 373 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacattaaccagctgcattaatgaatcggccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25889 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25890 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggtcctgccagggctgcgtcctaaccggcgtctgggtcatagcccacgagtgcggccaccacgccttcagcgactac

SEQ ID NO: 25891 - DNA, 394 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgccggtgctgtgccaggcccacggcttgaccccccagcaggtggtgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaatggtgcgtcctaaccggcgtctgggtcatagcccacgagtgcggccaccacgccttcagcgactac

SEQ ID NO: 25892 - DNA, 348 bp, Artificial
  Mutation in BnaA.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25893 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25894 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25895 - DNA, 380 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgatggccaccacctgctccggggacaagccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25896 - DNA, 344 bp, Artificial
  Mutation in BnaA.FAD2.a introduced by TALE nuclease pair BnFAD2_T03
caggatccatgggtgcaggtggaagaatgcaagtgtcccctccctccaagaagtctgaaaccgacaccatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25897 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacaacaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25898 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 25899 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25900 - DNA, 354 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgattgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25901 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25902 - DNA, 380 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgatggccaccacctgctgaggggtcaagccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25903 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacctcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25904 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 25905 - DNA, 409 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaggcaattcttcatctaatctaatattgattgaatgtctgagcattccgacactttcatgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25906 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaataccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25907 - DNA, 373 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactgccaggcatcaaactaagcagaaggccatccgtcaaacgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25908 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25909 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25910 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25911 - DNA, 308 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 25912 - DNA, 394 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgccggtgctgtgccaggcccacggcttgaccccccagcaggtggtgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 25913 - DNA, 330 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 25914 - DNA, 428 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgcgcgtaaccaccacacccgccagcgccctagcgcccgctcctttcgctttcttcccttcctttctcgccacgttcgagaactcaagaaagcaatcccaccgcactgtttcaaacgctcgatccctcgctctttctcctacctcatctgcgacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 25915 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25916 - DNA, 405 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcaacagccgctggaccgtctccagcgcctgcttgccaccattattgctggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25917 - DNA, 305 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcttcaaacgctccatccctcgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 25918 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25919 - DNA, 345 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcagacctcaagaaagcaatcccaccgcactgtttcaaacgctcgatccctcgctctctctcctatctcatcttggacatcatcatagcctcctgcttctactacgtcgccaccacttacttccctctcctccctccccctctctcctacttcgcctggcctctctactgggcctgccagggctgcgtcctaaccggcgtctgggtcatagcccacgagtgcggccaccacgccttcagcgactac

SEQ ID NO: 25920 - DNA, 305 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25921 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaagaactcaagaaagcaatcccaccgcactgtttcaaacgctcgatccctcgctctttctcctacctcatctgggacatcatcatagcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 25922 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25923 - DNA, 324 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25924 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 25925 - DNA, 419 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccagcggctgttgccggtgctgtgccaggcccacggcttgacccctcagcaggtggtggccatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25926 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccatcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25927 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25928 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25929 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttcttctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25930 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccagggctgcgtcctaaccggcgtctgggtcatagcccacgagtgcggccaccacgccttcagcgactac

SEQ ID NO: 25931 - DNA, 442 bp, Artificial
  Mutation in BnaA.FAD2.a introduced by TALE nuclease pair BnFAD2_T03
caggatccatgggtgcaggtggaagaatacaagtgtctcctccctccaaaaagtctgaaaccgacaacatcaagcgcgtaccctgcgagacaccgcccttcactgtcggctgttgccggtgctgtgccaggcccacggcttgaccccggagcaggtggtggccatcgccagccacgatggcggcaacagccgctggacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25932 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaacctacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25933 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25934 - DNA, 412 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggctgttgccggtgctgtgccaggcccacggcttgaccccggagcagggggtggccatcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaaccggcgtctgggtcatagcccacgagtgcggccaccacgccttcagcgactac

SEQ ID NO: 25935 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 25936 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25937 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 25938 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25939 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25940 - DNA, 404 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 25941 - DNA, 394 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgccggtgctgtgccaggcccacggcttgaccccccagcaggtggtgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25942 - DNA, 316 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccagccttcagcgactac

SEQ ID NO: 25943 - DNA, 403 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgttaggtacctcgcgaatgcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25944 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25945 - DNA, 350 bp, Artificial
  Mutation in BnaA.FAD2.a introduced by TALE nuclease pair BnFAD2_T03
caggatccatgggtgcaggaggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25946 - DNA, 442 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgtccagcggctgttgccggtgctgtgccaggcccacggcttgaccccggagcaggtggtggccatcgccagccacgatggcggcaagcaggcgctggagagagacctcaagaaagcaatcccacctcactgcttcaaacgctccatccctctctccttctcctacctcatctgggacatcatcatagcctcctccttctactacgtcgccaccacgtacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25947 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaaccggcgtctgggtcatagcccacgagtgcggccaccacgccttcagcgactac

SEQ ID NO: 25948 - DNA, 350 bp, Artificial
  Mutation in BnaA.FAD2.a introduced by TALE nuclease pair BnFAD2_T03
caggatccatgggtgaaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25949 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 25950 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25951 - DNA, 430 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgctgtgcctggcccacggcttgaccccccagcaggtggtggccatcgccagcaatggcggtggcaagcaggcgctggagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25952 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25953 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgaccggagcactcaagaaagcaaacccaccgcactgtttcagacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcggccaccacgccttcagcgactac

SEQ ID NO: 25954 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25955 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25956 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 25957 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25958 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 25959 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaaccggcgtctgggtcatagcccacgagtgcggccaccacgccttcagcgactac

SEQ ID NO: 25960 - DNA, 280 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25961 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25962 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25963 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25964 - DNA, 328 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgactcaagaaagcaatcccacctcactgcttcaaacgctccatcccacgctccttctcctacctcctcttcgacatcctcgtctcctcctcggctcctccctctaccacctctccacagcctacttccctctctcctacttcgcctggcctctctactgggccgccagggctgcgtcctaaccggcgtctgggtcatagcccacgagtgcggccaccacgccttcagcgactac

SEQ ID NO: 25965 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcctccctcaccctatctcctacttcgcctggcctctctactgggcctgccaagggtgcgtcctaaccggcgtctgggtcatagcccacgagtgcggccaccacgccttcagcgactac

SEQ ID NO: 25966 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaacctacaacatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 25967 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaacctgcgagacaccgcccttcactgtcggcggagaactcaagaaagcaatcccaccgcactgtttcaaacgctcgagccctcgctctttctcctacctcatctgggacatcatcatagcctcctgcttctactacgtcgccaccacttacttccctcccctccctcaccctctctcctacttcgcctggcctctctactgggcctgccagtgctgcgtcctaaccggcgtctgggtcatagcccacgagtgcggccaccacgccttcagcgactac

SEQ ID NO: 25968 - DNA, 397 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagcaggtggtggccatcgccagccacgatggcggcaagcaggcgctggagaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 25969 - DNA, 356 bp, Artificial
  Mutation in BnaA.FAD2.a introduced by TALE nuclease pair BnFAD2_T03
caggatccatgggtgcaggtggaagaatgcaagtgtctcctccttccaaaaagtctgaaaccgacaacatcaagcgcgtaccctgcgagacaccgcccttcacttcttccaccgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctcaccggcgtctgggtcatagcccacgagtgcggccaccacgccttcagcgactac

SEQ ID NO: 25970 - DNA, 410 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgactcaagacgatagttaccggataaggcgcagcggtcgggctgaacggggggtcgaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagtccacgagtgcggccaccacgccttcagcgactac

SEQ ID NO: 25971 - DNA, 325 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 25972 - DNA, 386 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgccagccacgatggcggcaacagccgctggaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25973 - DNA, 345 bp, Artificial
  Mutation in BnaA.FAD2.a introduced by TALE nuclease pair BnFAD2_T03
caggatccatgggtgcaggtggaagaatgcaagtgcatcctccctccaaaaagtctgaaaccgacaacatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25974 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25975 - DNA, 411 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcctggcacagcaccggcaacagccgctggaccgtctccagcgcctgcttgccaccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25976 - DNA, 404 bp, Artificial
  Mutation in BnaA.FAD2.a introduced by TALE nuclease pair BnFAD2_T03
caggatccatgggtgcaggcggaagaatgcaagtgtctcctccctccaaaaagtctgaaaccgacaacatcaagcgcgtaccctgcgagacaccgcccttcactgtggtggccatcgccgtgggcctggcacagcaccggcaacagccgctggaccgtctagaactcaagaaagcaatctcaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggtcaccacgccttcagcgactac

SEQ ID NO: 25977 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25978 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccagggctgcgtcctaaccggcgtctgggtcatagcccacgagtgcggccaccacgccttcagcgactac

SEQ ID NO: 25979 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25980 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctatactgggcctgccaagggtgcgtcctaaccggcgtctgggtcatagcccacgagtgcggccaccacgccttcagcgactac

SEQ ID NO: 25981 - DNA, 314 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25982 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 25983 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25984 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgttgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25985 - DNA, 308 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaaagcaatcccacagcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25986 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggatcatagcccacgagtgcggccaccacgccttcagcgactac

SEQ ID NO: 25987 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtgaacgctctcctgagtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25988 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctcgcccacttcgcctggcctctctactgggcctgccaagggtgcgtcctcaccggcgtctgggtcatagcccacgagtgcggccaccacgcctccagcgactac

SEQ ID NO: 25989 - DNA, 282 bp, Artificial
  Mutation in BnaA.FAD2.a introduced by TALE nuclease pair BnFAD2_T03
caggatccatgggtgcaggtggaagaatgcaagtctctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25990 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25991 - DNA, 373 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacattaaccagctgcattaatgaatcggccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25992 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcccaccgcactgtttcaaacgctcgatccctcgctctttctcctacatcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25993 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25994 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 25995 - DNA, 345 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 25996 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatccgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 25997 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggcttcgtcctaaccggcgtctgggtcatagcccacgagtgcggccaccacgccttcagcgactac

SEQ ID NO: 25998 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 25999 - DNA, 409 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaggcaattcttcatctaatctaatattgattgaatgtctgagcattccgacactttcatgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26000 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26001 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26002 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26003 - DNA, 287 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26004 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactcc

SEQ ID NO: 26005 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26006 - DNA, 425 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgctttccagtcgggaaacctgtcgtgccagctgcattaatgaatcggccaacgcgcggggagaggcggtttgcgtgaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26007 - DNA, 409 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgttgcactgacgggtgccccgctcaacttgaccccccagcaggtggtggccatcgccagcaataatggtggcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtaatagcccacgagtgcggccaccacgccttcagcgactac

SEQ ID NO: 26008 - DNA, 344 bp, Artificial
  Mutation in BnaA.FAD2.a introduced by TALE nuclease pair BnFAD2_T03
caggatccatgggtgcaggtgcaagaatgcaagtgtatcctccctccaagaagtctgaaaccgacaccatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccacgacgccttcagcgactac

SEQ ID NO: 26009 - DNA, 402 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctccttcctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26010 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtctccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26011 - DNA, 393 bp, Artificial
  Mutation in BnaA.FAD2.a introduced by TALE nuclease pair BnFAD2_T03
caggatccattggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26012 - DNA, 413 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgccgctggaccgtctccagcgcctgcttgccaccattattgctggcgatggccactacctgcttaactcaagaaagcaatcccaccgcactgtttcaaacgctcgatccctcgctctttctcctacctcatctgggccatcctcgtctcctcctccctctaccacctctccacagcctacttccctcccctcccccaccctctcccttccctcgcctggcccctctactgggcctgccaaggctgcgtcctaacgggcctctgggtcatcgcccacgaatgcgcccaccacgccttcagcgactac

SEQ ID NO: 26013 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctcaccggcgtctgggtcatagcccacgagtgcggccaccacgccttcagcgactac

SEQ ID NO: 26014 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcttggtcatagcccacgagtgcggccaccacgccttcagcgactac

SEQ ID NO: 26015 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccagggctgcgtcctaaccggcgtctgggtcatagcccacgagtgcggccaccacgccttcagcgactac

SEQ ID NO: 26016 - DNA, 403 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcggctgttgccgccatcgtggctggcgatggccaccacctgctccggagaactcaagaaagcaatcccaccgcactgtttcaaacgctcgctccctcgcgctttctcctacctcatcggggacatcatcatagcctcctgcttctactacgtcgccaccacttacttccctctcctccctcaccctctctcctacttcgcctcgcctctctactgggcctgccagggctgcgtcctagccggcgtctgggtcatagcccacgagtgcggccaccacgccttcagcgaccac

SEQ ID NO: 26017 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26018 - DNA, 356 bp, Artificial
  Mutation in BnaA.FAD2.a introduced by TALE nuclease pair BnFAD2_T03
caggcatgggtgcaggtggaagaatgcaagtgtctcctccctccaagaagtctgaaaccgacaccatcaagcgcgtaccctgcgagacaccgcccttcacgtctccagcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26019 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26020 - DNA, 425 bp, Artificial
  Mutation in BnaA.FAD2.a introduced by TALE nuclease pair BnFAD2_T03
caggatccatgggtgcaggtggaagaatgcaagtgtctcctccccccaagaagtctgaaaccgacaacatcaagcgcgtaccctgcgagacaccgcccttcactgtcgctttccagtcgggaaacctgtcgtgccagctgcattaatgaatcggccaacgcgcggggagaggcggtttgcgtgaactcaagaaagcaaaccccccgcactgtttcaaacgctcgatccctcgctctttcgcctacctcatctgggacatcatcatagcctcctgcttctactacgtcgccaccacgtacttccctctcctccctcaccctctctcctacttcgcctggcctctctactgggcctgccagggctgcgtcctaaccggcgtctgggtcatagccctcgagtgcggccaccacgccttcagcgactac

SEQ ID NO: 26021 - DNA, 349 bp, Artificial
  Mutation in BnaA.FAD2.a introduced by TALE nuclease pair BnFAD2_T03
caggatccatgggtgcaggtggaagaatgcaagtgtctccttccatcaaaaagtctgaaaacgacaacatcaagcgcgtaccctgcgagacaccgcccttcactgtgaaatcaagaaagcaatcccaccgcactgtttcaaacgctcgatccctcactctttctcctacctcatctgggacatcatcatagcctcctgcttctactacggcgccaccacttacttccctctcctccctcaccctctctcctacttcgccaagcctctctactgggcctgccagagctgcgtcctaaccggcctctgggtcatatcccacaagtgctgccaccacgccatcaacgactac

SEQ ID NO: 26022 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactcgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26023 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 26024 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26025 - DNA, 372 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggcggcaagcaggcgctggaggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26026 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26027 - DNA, 326 bp, Artificial
  Mutation in BnaA.FAD2.a introduced by TALE nuclease pair BnFAD2_T03
catgatccatgggtgcaggtggaagaatgcaagtgtctcctccctccaagaagtctgaaaccgacaccatcaagcgcgtaccctgcgagacaccgcccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26028 - DNA, 308 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactctttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagtgactac

SEQ ID NO: 26029 - DNA, 444 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgtgggcctggcacagcaccggcaacagcgcctgcaccgtctccagcgctggtttgccaccaatattgctggcgatggccaccacctgctacggagaactcaagaaagcaatcccaccgcactgtttcaaacgctcgatccctcgctctttctcctccctcatctgggacctcatcatagcctcctgcttctactacgtcgccaccacttacttccctctcctccctcaccctctctcctacttcgcctggcctctctactgggcctgccagggctgcgtcctagccggcgtctgggtcatagcccacgagtgcggccaccacgccttcagccactac

SEQ ID NO: 26030 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 26031 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgattgcggccaccacgccttcagcgactac

SEQ ID NO: 26032 - DNA, 341 bp, Artificial
  Mutation in BnaA.FAD2.a introduced by TALE nuclease pair BnFAD2_T03
caggatccagggtgcaggtggaagaatgcaagtgtctcctccctccaagaagtctgaaacagacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcttcctaaccggcgtcggggtcatagcccgcaagtgcggccaccacgccttcatcgactac

SEQ ID NO: 26033 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcacctggcctctctactgggcctgccagggctgcgtcctaaccggcgtctgggtcatagcccacgagtgcggccaccacgccttcagcgactac

SEQ ID NO: 26034 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtcccctgcgagacaccaccattcacctgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26035 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccacctcactgctacaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26036 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 26037 - DNA, 314 bp, Artificial
  Mutation in BnaA.FAD2.a introduced by TALE nuclease pair BnFAD2_T03
caggatccatgggtgcaggtggaggaatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26038 - DNA, 348 bp, Artificial
  Mutation in BnaA.FAD2.a introduced by TALE nuclease pair BnFAD2_T03
caggacccatgggtgcaggtggaagaatgcaagtgcctcctgcctccaaaaagactgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacctggcctctctactgggcctgccagggctgcgtcctaaccggcgtctgggtcatatcccgcgagtggtgccaccacgccatgagcgactac

SEQ ID NO: 26039 - DNA, 351 bp, Artificial
  Mutation in BnaA.FAD2.a introduced by TALE nuclease pair BnFAD2_T03
caggatccatgggtgcaggtgcaagaatgcaagtctctcctccctccagctcccccggacccaataccctcaaacgcgtcccctgcgagacaccaccattcactctcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26040 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccccctcctccctcaccctctctcctacttcgcctggcctctctactgggcctgccagggctgcgtcctaaccggcgtctgggtcatagcccacgagtgcggccaccacgccttcagcgactac

SEQ ID NO: 26041 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacgacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26042 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26043 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26044 - DNA, 423 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcgatggccaccacctgctccggggtcaagccgtgggcctggcacagcaccggcaacaggcgctggagactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26045 - DNA, 318 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttactgtttcaaacgctcaagccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26046 - DNA, 348 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 26047 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctctctactgagccggccaggactgcgtcctaaccggcgtctgggtcatatcccacgagtgcggccaccacgccttcagcgactac

SEQ ID NO: 26048 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26049 - DNA, 377 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggggttccgatttagtgctttacggggagaactcaagaaagcaatcccaccgcactgtttcaaacgctcgatccctcgctctttctcctacctcatctgggacatcatcatagcctcctgcttctactacgtcgccaccacttacttccctctcctccctctccctctctcctacttcgcctggcctctctactgggcctgccaagggtgcgtcctaaccggcgtctgggtcatagcccacgagtgcggccaccacgccttcagcgactac

SEQ ID NO: 26050 - DNA, 414 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctaaaaaagcattgctcatcaatttgttgcaacgaacaggtcactatcagtcaaaataaaatcattatttgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26051 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26052 - DNA, 280 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 26053 - DNA, 344 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccatagcctttctagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26054 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26055 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26056 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacctccctccaagtgtctcctccctcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26057 - DNA, 353 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgattgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgacac

SEQ ID NO: 26058 - DNA, 349 bp, Artificial
  Mutation in BnaA.FAD2.a introduced by TALE nuclease pair BnFAD2_T03
caggatccatgggtgcaggcggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgtggccaccacgccatcagcgactac

SEQ ID NO: 26059 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtactaacgggcctctgggtcatagcccacgagtgcggccaccacgccttcagcgactac

SEQ ID NO: 26060 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26061 - DNA, 325 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26062 - DNA, 308 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26063 - DNA, 348 bp, Artificial
  Mutation in BnaA.FAD2.a introduced by TALE nuclease pair BnFAD2_T03
caggatccatgggtgcaggtggaagaatgcaagtgtctcctccctctaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26064 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26065 - DNA, 355 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttttggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26066 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaacctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggtctctctactgggcctgccagggctgcgtcctaaccggcgtcttggtcatagcccacgagtgcggccaccacgccttcagcgactac

SEQ ID NO: 26067 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctagacctcaagaaagcaatcccacctcactgcttcaaacgctccatccctcgctccttctcctacctcatctgggacatcatcatagcctcctgcttctactacgtcgccaccacttacttccctctcctccatcaccctctctcctacttcgcctggcctctctactgggcctgccagggctgcgtcctaacgggcctctgggtcatagcccacgagtgcggccacaacgccttcagcgactac

SEQ ID NO: 26068 - DNA, 377 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgcgatggcggcaagcaggcgctggagaagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacgtcgcctggcctctctactgggcctgccagggctgcgtcctaaccggcgtctgggtcatagcccacgagtgcggccaccacgccttcagcgactac

SEQ ID NO: 26069 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctccatccctcgctccttctcctacctcctcttcgacatcctcgtctcctcctccctctaccacctctccacagcctacttccctctcctcccccaccctctccctttccccgcctggcctctctactgggcctgccagggctgcgtcctaaccggcgtctgggtcatagcccacgagtgcggccaccagccttcatcgactcc

SEQ ID NO: 26070 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26071 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctctctactgggcctgccagggctgcgtcctaaccggcgtctgggtcatagcccacaattgcggccaccacgccatcagcgactac

SEQ ID NO: 26072 - DNA, 349 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26073 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26074 - DNA, 410 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggttcagcctggtcagctgggccttgtagttgcccttgaagtggccggacacgaacaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26075 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccagggctgcgtcctcacgggcctctgggtcatcgcccacgagtgcggccaccacgccttcagcgactac

SEQ ID NO: 26076 - DNA, 423 bp, Artificial
  Mutation in BnaA.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactgtcggcgatggccaccacctgctccggggtcaagccgtgggcctggcacagcaccggcaacagccgctggagactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26077 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26078 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26079 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctggttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 26080 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26081 - DNA, 338 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26082 - DNA, 359 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggatcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26083 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26084 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 26085 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccaccgcactgtttcaaacgctcgatccctcgccctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccgtcagcgactac

SEQ ID NO: 26086 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttcttccaccgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26087 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26088 - DNA, 388 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgctagacaccgcccttcactcacccgtcagtgcattgcgccatgcatgcactgcctccagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26089 - DNA, 389 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcttcaagtatgacgggctgatactgggccggcaggcgctccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26090 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgagaacatcaagcgcgtaccctgcgagacaccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26091 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctttactgggcctgctaagggtgcgtcctaaccggcgtctgggtcatagcccacgagtgcggccaccacgccttcagcgactac

SEQ ID NO: 26092 - DNA, 349 bp, Artificial
  Mutation in BnaA.FAD2.a introduced by TALE nuclease pair BnFAD2_T03
caggatccatgggtgcaggtggaagaatgcaagtgtctcctccacccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26093 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaaggctgaaaccgacaacatcaagcgcgtaccctgcgagacactggagacggtctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 26094 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26095 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26096 - DNA, 379 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggccacgatggcggcaacagccgctggagggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccaagccttcagcgactac

SEQ ID NO: 26097 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcgaccaccacgccttgagcgactac

SEQ ID NO: 26098 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26099 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26100 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26101 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgacta

SEQ ID NO: 26102 - DNA, 348 bp, Artificial
  Mutation in BnaA.FAD2.a introduced by TALE nuclease pair BnFAD2_T03
caggatccatgggtgcggtggaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26103 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26104 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 26105 - DNA, 339 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26106 - DNA, 392 bp, Artificial
  Mutation in BnaA.FAD2.a introduced by TALE nuclease pair BnFAD2_T03
caggatccatgggtgcaggtggaagaatgcaagtgactcctccctccaaaaagtctgaaaccgacaacatcaagcgcgtaccatgcgagacaccgcccttcactgtcgtaatctggaacatcgtatgggtaatcgatgaccttacgtttaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26107 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 26108 - DNA, 423 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcgatggccaccacctgctccggggtcaagccgtgggtctggcacagcaccggcaacagccgctggagactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26109 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26110 - DNA, 344 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26111 - DNA, 346 bp, Artificial
  Mutation in BnaA.FAD2.a introduced by TALE nuclease pair BnFAD2_T03
caggatccatgggtgcaggtggaagaatgcaagtgtaacctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctcctggcctctctactgggcctgccaagggtgcgtcctaaccggcgtctgggtcatagcccacgagtgcggccaccacgccttcagcgactac

SEQ ID NO: 26112 - DNA, 354 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgggaagacctcatgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26113 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26114 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26115 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtgctaaccggggtctgggtcatagcccacgagtgcggccaccacgccttcagcgactac

SEQ ID NO: 26116 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26117 - DNA, 473 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgccttgaccaacgaccacctcgtcgccttggcctgcctcggcgggcgtcctgcgctggatgcagtgaaaaagggattggggggtcctatcagccgttcccagctggtgaagtccgagctgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26118 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26119 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26120 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 26121 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 26122 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgcttgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26123 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26124 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatatcccacgagtgcggccaccacgccttcagcgactac

SEQ ID NO: 26125 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 26126 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccaccgcactgtttcaaacactcgatccctcgctctttctcctacctcatctgggacatcatcatagcctcctgcttctactacgtcgccaccacttacttccctctcctccctcaccctctctcctacttcgcctcgcctctctactgtgcctgccaggcctgcgtcctaaccggcgtctgggtcatagcccacgagtgcggccaccacgccttcagcgactac

SEQ ID NO: 26127 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgatctttctcctacctcatctgggacatcatcatagcctcctgcttctactacgtcgccaccacttacttccctctcctacctcaccctctctcctacttcgcctggcctctctactgggcctgccaagggtgcgtcctaaccggcgtctgggtcatagcccacgactgcggccaccacgccttcagcgactac

SEQ ID NO: 26128 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 26129 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaaccggatcaaagagttcctccgccgctggacctaccaaggcaacgctatgttctaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26130 - DNA, 318 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26131 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26132 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26133 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatggcccacgagtgcggccaccacgccttcagcgactac

SEQ ID NO: 26134 - DNA, 277 bp, Artificial
  Mutation in BnaA.FAD2.a introduced by TALE nuclease pair BnFAD2_T03
caggatccatgtgtgcaggtggaagaatgcaagtgtctcctccctccaagaagtctgaaaccgacaccatcaagcgcgtaccctgcgagacaccgcccttcactgagacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26135 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaagactgcgtcctaacgggcctctgggtcatagcccacgagtgcggccaccacgccttcagcgactac

SEQ ID NO: 26136 - DNA, 352 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagccaacgagtgcggccaccacgccttcagcgactac

SEQ ID NO: 26137 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26138 - DNA, 317 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26139 - DNA, 469 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagccgctggaccgtctccagcgcctgcttgccaccgccattgctggcgatggccaccacctgctggggggtcaagccgtgggcctggcacagcaccggcaacagccgctggagatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26140 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 26141 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacctccctccaagtgtctcctccctcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcagggctgcgtcctaaccggcgtctgggtcatagcccacgagtgcggccaccacgccttcagcgactac

SEQ ID NO: 26142 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 26143 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcttggtcatagcccacgagtgcggccaccacgccttcagcgactac

SEQ ID NO: 26144 - DNA, 345 bp, Artificial
  Mutation in BnaA.FAD2.a introduced by TALE nuclease pair BnFAD2_T03
caggatccatgggtgcaggtggaagaatccaagtgtcacctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccgtcgtctgggtcatagcccacgagtgcggccaccacgccttcagcgactac

SEQ ID NO: 26145 - DNA, 351 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctgccctctctactgggcctgccaaggctgcgtcctaacgggcctctgggtcatagcccacgagtgcggccaccacgccttcagcgactac

SEQ ID NO: 26146 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26147 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccatgagtgcggccaccacgccttcagcgactac

SEQ ID NO: 26148 - DNA, 345 bp, Artificial
  Mutation in BnaA.FAD2.a introduced by TALE nuclease pair BnFAD2_T03
caggatccatgggtgcaggtggaagaatgcaagtgtctcctgcctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgtcctctctactgggcctgccaagggtgcgtcctaaccggcgtctgggtcatagcccacgagtgcggccaccacgccttcagcgactac

SEQ ID NO: 26149 - DNA, 382 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacagccgctggaccgtctccagcgcctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26150 - DNA, 377 bp, Artificial
  Mutation in BnaA.FAD2.a introduced by TALE nuclease pair BnFAD2_T03
caggatccatgggtgcaggtggaagaatgcaagtgtctcctccctcccaaaagtctgaaaccgacaacatcaagcgcgtaccctgcgagacaccgcccttcactgtggggttccgatttagtgctttacggggagaactcaagaacgcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26151 - DNA, 354 bp, Artificial
  Mutation in BnaA.FAD2.a introduced by TALE nuclease pair BnFAD2_T03
caggatccatgggtgcaggtggaagaatgcaagtgtatccaccctccaaaaagtctgaaaccgacaacatcaagcgcgtaccctgcgagacaccgcccttcactgtccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcttcctaaccggcgtcggggtcatagcccgcgagtgcggccaccacgccttcatcgactac

SEQ ID NO: 26152 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccttccagggctgcgtcctaaccggcgtctgggtcatagcccacgagtgcggccaccacgccttcagcgactac

SEQ ID NO: 26153 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26154 - DNA, 343 bp, Artificial
  Mutation in BnaA.FAD2.a introduced by TALE nuclease pair BnFAD2_T03
caggatccatgggtgcaggtggaagaatgcaagtgtctcctccctcccaaaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaagcggcgtcttggtcatagcccacgagtgcggccaccacgccttcagcgactac

SEQ ID NO: 26155 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26156 - DNA, 392 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtaatctggaacatcgtatgggtaatcgatgaccttacgtttaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26157 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctttcagcgactac

SEQ ID NO: 26158 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26159 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaacgacaacatcaagcgcgtaccctgcgagacacctccctccaagtgtctcctccctcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26160 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26161 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccatggctgcgtcctaaccggcgtctgggtcatagcccacgagtgcggccaccacgccttcagcgactac

SEQ ID NO: 26162 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttagaactcaagaaagcaatcccaccgcactgtttcaaacgctcgatccctcgctctttctcctacctcatctgggacatcatcatagcctcctgcttccactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 26163 - DNA, 433 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggtggcaagcaggcgctggagacggtccagcggctgttgccggtgctgtgccaggcccacggcttgaccccccagcaggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26164 - DNA, 337 bp, Artificial
  Mutation in BnaA.FAD2.a introduced by TALE nuclease pair BnFAD2_T03
caggatccatgggtgaggtggcagaatgcaagtgtctcctccctccacaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26165 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctacgagacaccacccttcactcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26166 - DNA, 336 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26167 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26168 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26169 - DNA, 372 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgctcacatgttctttcctgcgttatcccctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26170 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26171 - DNA, 318 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcgcgactac

SEQ ID NO: 26172 - DNA, 344 bp, Artificial
  Mutation in BnaA.FAD2.a introduced by TALE nuclease pair BnFAD2_T03
caggatccatgggtgcaggtggaagaatgtaagtctctcctccctccagctcccccgaaaccaaaaccctcaaacgcgtcccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgctac

SEQ ID NO: 26173 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26174 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaatgggcctctgggtcatagcccacgagtgcggccaccacgccttcagcgactac

SEQ ID NO: 26175 - DNA, 349 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaaacgcgtcccctgcgagacaccacccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26176 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 26177 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26178 - DNA, 347 bp, Artificial
  Mutation in BnaA.FAD2.a introduced by TALE nuclease pair BnFAD2_T03
caggatccatgggtgcaggtggaagaatgcaagtgtctcctccctcccaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26179 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctcgcctacttcgcctggcctctctactgggcctgccagggctgcgtcctaaccggcgtctgggtcatagcccacgagtgcggccaccacgccttcagcgactac

SEQ ID NO: 26180 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 26181 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26182 - DNA, 346 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26183 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcttggtcatatcccacgagtgcggccaccacgccttcagcgactac

SEQ ID NO: 26184 - DNA, 357 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtccgatctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26185 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccacactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 26186 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggttcatagcccacgagtgcggccaccacgccttcagcgactac

SEQ ID NO: 26187 - DNA, 350 bp, Artificial
  Mutation in BnaA.FAD2.a introduced by TALE nuclease pair BnFAD2_T03
caggatccatgggtgcaggtggaagaatgcaagtgtcccctccctccaaaaagtctgaacccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatcccctagcctctctactgggcctgccagggctgcgtcctaaccggcgtctgggtcatagcccacaagtgcggccaccacgccatcaacgactac

SEQ ID NO: 26188 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26189 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaaccctgaaaccgacaacctcaagcgcgtaccctgcgagacaccacccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26190 - DNA, 393 bp, Artificial
  Mutation in BnaA.FAD2.a introduced by TALE nuclease pair BnFAD2_T03
caggatccatgggtgcaggtggaagaatgcaagtgcctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26191 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcatcctaaccggcgtctgggtcatagcccacgagtgcggccaccacgccttcagcgactac

SEQ ID NO: 26192 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26193 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccttcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctcccgcaccctctctcctacgtcgcctggcctctctactgggcctgccagggctgcatcctaaccggcgtctgggtcatagcgcacgagtgcggccaccacgccatcagcgactac

SEQ ID NO: 26194 - DNA, 348 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26195 - DNA, 349 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccacctcgccttcagcgactac

SEQ ID NO: 26196 - DNA, 314 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccaacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26197 - DNA, 337 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaccatcaagcgcgtaccctgcgagacaccgcccttcactgtgagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 26198 - DNA, 422 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcaagcaggcgctggagacggtccagcggctgttgccggtgctgtgccaggcccacggcttgaccacggcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26199 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcctctctactgggcctgccaagggtgcgtcctaaccggcgtctgggtcatagcccacgagtgcggccaccacgccttcagcgactac

SEQ ID NO: 26200 - DNA, 338 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctccaaaaacacacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26201 - DNA, 341 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26202 - DNA, 342 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcacccgctctcctacttcccctggcctctctactgggcctgccagcgctgcgtcctaaccggcgtctggtgcatagcccacgagtgcggccaccacgccttcagcgacta

SEQ ID NO: 26203 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 26204 - DNA, 413 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtcggccatcgccagcaatggcggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 26205 - DNA, 351 bp, Artificial
  Mutation in BnaA.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26206 - DNA, 419 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggcggtggcaagcaggcgctggagacggtccagcggatgttgccggtgctgtgccaggcccacggcttgaccccccagcaggagaactcaagaaagcaatcccaccgcactgtttcaaacgctcgatcccacgctccttctcctcttcgacatcatcacctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 26207 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccgtcgtctgggtcatagcccacgagtgcggccaccacgccttcagcgactac

SEQ ID NO: 26208 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26209 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgggcctgccagggctgcgtcctaaccggcgtctgggtcatagcccacgagtgcggccaccacgccttcagcgactac

SEQ ID NO: 26210 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26211 - DNA, 338 bp, Artificial
  Mutation in BnaA.FAD2.a introduced by TALE nuclease pair BnFAD2_T03
caggatccatgggtgcaggtggaagaatgcaagtgactcctccctcccagaagcctgaaaccgacaccatccagcgcgtaccctgcgagacaccgcccttcaagaaagcaatcccaccgcactgtttcaaacgctcgatccctcgctctttctcctacctcatctgggacatcatcatagcctcctgcttctactacgtcgccacaacttacttccctctcctccctcaccctctctcctacttcgcctggcctctctactgggcctgccagggctgcgtcctaaccggcgtctgggtcatagcccacgagtgcggccacgacgccttcagcgactac

SEQ ID NO: 26212 - DNA, 355 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcaactac

SEQ ID NO: 26213 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcacgcgcgtaccctgcgagacaccgcccttcactgtagaactcaagaaagcaatcccaccgcactgtttcaaacgatcgatccctcgctcgttctcctacctcatctgggacatcatcatagcctcctgcttctactacgtcgccaccacttacttccctctcctccctcaccctctctcctacctcgcctggcctctctactgggcctgccagggctgcgtcctaacgggcctctggtgcatcgcccacgaatgcggccaccacgccttcagcgactac

SEQ ID NO: 26214 - DNA, 348 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26215 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactgtagaactcaagaaggcaatcccaccgcactgttgcaaacactcgacccctcgcgctttctcctacctcatctggtacatcatcatagcctccttcttcccctacgtcgccaccactcacttccctctcctccctcaccctctctcctacttcgcctggcccctctactgggcctgccagggctgcgtcctaaccggcctctgggtcatagcccacgagtgcggccaccacgccttcagcgactac

SEQ ID NO: 26216 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26217 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26218 - DNA, 350 bp, Artificial
  Mutation in BnaA.FAD2.a introduced by TALE nuclease pair BnFAD2_T03
caggatccatgggtgcaggtggaagaatgcaagtgtatcctccctccaaaaagcctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggacccctctactgggcctgccaaggctgcgtcctaacggggctcggggtcatagcccacgagtgcggccaccacgcctttatcgactac

SEQ ID NO: 26219 - DNA, 349 bp, Artificial
  Mutation in BnaA.FAD2.a introduced by TALE nuclease pair BnFAD2_T03
caggatccatgggtgcaggtggaagaatgcaagtctctcctccctccagctccccgaaaccaaaaccctcaaacgcgtcccctgcgagacaccacccttcactctcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26220 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgattac

SEQ ID NO: 26221 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26222 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26223 - DNA, 419 bp, Artificial
  Mutation in BnaA.FAD2.a introduced by TALE nuclease pair BnFAD2_T03
caggatccatgggtgcaggtggcagaatgcaagtgtctcctccatccaagaagtctgaaaccgacaccatcaagcgcgtaccctgcgagacaccgcccttcactgtccgactgagcctttcgttttatctgttgtttgtcggtgaacgctctcctgagtaggacaaatccgccggagaactcaagaaagcaatcccaccgcactgtttcaaacgctcgatccctcgctctttctcctacctcatctgggacatcatcatagcctcctgcttctactacgtcgccaccacgtacttccctctccgccctcaccctctctcctacttcgcctggcctctctactgggcctgccagggctgcgtcctaaccggcgtctgggtcatagcccacgagtgcggccaccacgccttcagcgactac

SEQ ID NO: 26224 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccagggctgcgtcctaaccggcgtctgggtcatagcccacgagtgcggccaccacgccttcagcgactac

SEQ ID NO: 26225 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtcataaaccgacaacatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26226 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaccgcgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26227 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26228 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26229 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 26230 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26231 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcacgcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccgccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26232 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26233 - DNA, 377 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggggttccgatttagtgctttacggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26234 - DNA, 414 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggggcggagcctatggaaaaacgccaggaaccgtaaaatatcaaccatagtacgcgccgctagaactcaagaaagcaatcccaccgcactgtttcaaacgctcgatccctcgctctttctcctacctcatctgggacatcatcatagcctcctgcttctactacgtcgccaccacttacttccctctcctccctcaccctcgctcctacttcgcctggcctctctactgggcctgccaagggtgcgtcctaaccggcgtcttggtcatagcccacgagtgctgccaccacgccttcagcgactac

SEQ ID NO: 26235 - DNA, 295 bp, Artificial
  Mutation in BnaA.FAD2.a introduced by TALE nuclease pair BnFAD2_T03
caggatccatgggtgcaggtggaagaatgcaagtgtctcctccccccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgctaagggtgcgtcctaaccggcgtctgggtcatagcccacgagtgcggccaccacgccttcagcgactac

SEQ ID NO: 26236 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtgagaactcaagaaagcaatcccaccgcactgtttcaaacgctcgatccctcgctctttctcctacctcatctgggacatcatcatagcctcctgcttctactacgtcgccaccacttccttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26237 - DNA, 308 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26238 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccgaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 26239 - DNA, 349 bp, Artificial
  Mutation in BnaA.FAD2.a introduced by TALE nuclease pair BnFAD2_T03
caggatccatgggtgcaggtggaagaatgcaagtgtgtcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccagggctgcgtcctaacgggcctctgggtcatagcccacgagtgcggccaccacgccttcagcgactac

SEQ ID NO: 26240 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctgacctcaagaaagcaatcccacctcactgattcaaacgctccatccctcgctccttttcctacctcatctgggacatcatcatagcctcctgcttctactacgtcgccaccacttacttccctctcctccctcaccctctctcctacttcgccttgcctctctactgggcctgccagggctgcgtcctaaccggcgtctgggtcatagcccacgagtgcggccaccacgccttcagcgactac

SEQ ID NO: 26241 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggcctgcgtcctaaccggcctctgggtcatagcccacgagtgcggccaccacgccatcagcgaccac

SEQ ID NO: 26242 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcataagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgatac

SEQ ID NO: 26243 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 26244 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctatccggcgtctgggtcatagcccacgagtgcggccaccacgccttcagcgactac

SEQ ID NO: 26245 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 26246 - DNA, 350 bp, Artificial
  Mutation in BnaA.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26247 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacctccctccaagtgtctcctccctcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 26248 - DNA, 341 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacctccctccaagtgtctcctccctcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgacta

SEQ ID NO: 26249 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtccgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 26250 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 26251 - DNA, 392 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtaatctggaacatcgtatgggtaatcgatcaccttacgtttaaactcaagaaagcaatcccaccgcactgtttcaaacgctcgatccctcgctctttctcctacctcacctgggacatcatcatagcctcctgcttctactacgtcgccaccacttacctccctctcctccctcaccctctctcctacttcgcctggcctctctactgggcctgccagggctgcgtcctaaccggcctctgggtcatagcccacgagtgcggccaccacgccctcagcgactac

SEQ ID NO: 26252 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccacactgattcaaacgctctgtccctcgctctttctcctacctcatctcgcacatcatcatagcctcctgcttctactacgtcgccaccccttacttccctctcctccctcaccctctcccctacttcgcctggcctctctactgggcctgccagggctgcgtcctaaccggcgtctgggtcatagcccacgagtgcggccaccacgccttcagcgactac

SEQ ID NO: 26253 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcacgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26254 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26255 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggcggcgtcctaacgggcctctgggtcatagcccacgagtgcggccaccacgccttcagcgactac

SEQ ID NO: 26256 - DNA, 340 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgccctactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcgtctgggtcatagcccacgagtgcggccaccacgccttcagcgactac

SEQ ID NO: 26257 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26258 - DNA, 345 bp, Artificial
  Mutation in BnaA.FAD2.a introduced by TALE nuclease pair BnFAD2_T03
caggatccatgggtgcaggttgaagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26259 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26260 - DNA, 413 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggccatcgccagcaatggcggtggcaagcaggcgctggagacggtccagcggctgtttccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26261 - DNA, 350 bp, Artificial
  Mutation in BnaA.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26262 - DNA, 319 bp, Artificial
  Mutation in BnaA.FAD2.a introduced by TALE nuclease pair BnFAD2_T03
caggatccatgggtgcaggtggaagaatgcaagtgtctcctccctcaaaaaagcctgaaaccgccaacttcaagcgcgtcccctgcgagacaccgcccttaactgtttcaaacccccgatccctcgctctttctcctacctcacctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26263 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26264 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactaactcaagaaagcaatcccacctcactgcttcaaacgctcgatccctcgctctttctactacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26265 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatcgcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26266 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 26267 - DNA, 346 bp, Artificial
  Mutation in BnaA.FAD2.a introduced by TALE nuclease pair BnFAD2_T03
caggatccatgggtgcaggtggaagaatgcaagtgtctcctccctccagcaagcctgaaaccgacaccatcaagcgcgtcccctgcgagacaccacccttcacgcactcaagacagcaaccacaccgcactgttccaaacgctcgatccctcgcaccttcccctacctcatctcagacattctcatagcttcctgcctctactacgtcgccaccacgtacttccctatcctccctcaccctctctcctacttcgcctggcctctctactgggcctgccagggctgcgtcctaaccggcgtctgggtcatagcccacgaatgcggccaccacgccttcagcgactac

SEQ ID NO: 26268 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26269 - DNA, 349 bp, Artificial
  Mutation in BnaA.FAD2.a introduced by TALE nuclease pair BnFAD2_T03
caggatccatgggtgcagggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26270 - DNA, 338 bp, Artificial
  Mutation in BnaA.FAD2.a introduced by TALE nuclease pair BnFAD2_T03
caggatccatgggtgcaggtcgcagaatgcaagtgtatcctccctccaagaagtctgaaaccgacaccatcaagagcgtaccctccaaaaacacacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26271 - DNA, 350 bp, Artificial
  Mutation in BnaA.FAD2.a introduced by TALE nuclease pair BnFAD2_T03
caggatccatgggtgcaggtggaagaatgcaagtgtatcctcactccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26272 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctaatgggcctgccaagggtgcgtcctaaccggcgtctgggtcatagcccacgagtgcggccaccacgccttcagcgactac

SEQ ID NO: 26273 - DNA, 379 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctccttctcctcttcgacatcatcatctcctcctcggctcctccctctaccccctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 26274 - DNA, 380 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgatggccaccacctgctccggggtcaagccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26275 - DNA, 380 bp, Artificial
  Mutation in BnaA.FAD2.a introduced by TALE nuclease pair BnFAD2_T03
caggatccatgggtgcaggtggcagaatgcaagtgtctcctcccaccaaaaagtctgaaaccgacaacatcaagcgcgtaccctgcgagacaccgcccttcactgtcgatggccaccacctgctccggggtcaagccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26276 - DNA, 343 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctccctctaccacctctccacagcctacttccctctcctcccccaccctctctcctacttcgcctggcctctctactgggcctgccaagggtgcgtcctaaccggcgtcggggtcatagcccacgagtgcggccaccacgccttcagcgactac

SEQ ID NO: 26277 - DNA, 350 bp, Artificial
  Mutation in BnaA.FAD2.a introduced by TALE nuclease pair BnFAD2_T03
caggatccatgggtgcaggtggaagaatgcaagtgtcccctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26278 - DNA, 349 bp, Artificial
  Mutation in BnaA.FAD2.a introduced by TALE nuclease pair BnFAD2_T03
caggatccatgggtgcaggtggaagaatgcaagtgtctgctccctccaaaaagtctgaaaccgacaacatcaagtgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26279 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 26280 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26281 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 26282 - DNA, 359 bp, Artificial
  Mutation in BnaA.FAD2.a introduced by TALE nuclease pair BnFAD2_T03
caggatccatgggtgcaggtggaagaatgcaagtgtctaccccctccaaaaagtctgaaaccgacaacctcaagcgcgtaccctgcgagacaccgcccttcacattaaccagctgcattaatgaatcggccaactcaagaaagcaatcccaccgcactgtttcaaacgctcgatccctcgctccttctcctcttcgacatcatcatctcctcctcggctcctccctctaccacctctccacagcctacttccctctcccttaccgcgcctgacccctctactgggcctgccaaggctgcgtcctgacgagcctctgggtcatagcccacgagtgcggccaccacgccttcagcgactac

SEQ ID NO: 26283 - DNA, 395 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcgggtcaagccgtgggcctggcacagcaccggcaacagccgctggagagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 26284 - DNA, 346 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 26285 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26286 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcgaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26287 - DNA, 386 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgccctgggggtcaagttgagcggggcacccgtcagtgcattgcgccagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26288 - DNA, 360 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26289 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 26290 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcgtctgggtcatagcccacgagtgcggccaccacgccttcagcgactac

SEQ ID NO: 26291 - DNA, 331 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaagggtgcgtcctaaccggcgtctgggtcatagcccacgagtgcggccaccacgccttcagcgactac

SEQ ID NO: 26292 - DNA, 411 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcgctcggtcgttcggctgcggcgagcggtatcagctcactcaaaggcggtaatacggtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactac

SEQ ID NO: 26293 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26294 - DNA, 350 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccagggctgcgtcctaaccggcgtctgggtcatagcccacgagtgcggccaccacgccttcagcgaccac

SEQ ID NO: 26295 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaacccaagaaagcaatcccaccgcactgtttcaaacgctccatccctcgctccttctcctacctcctcttcgacatcctcgtctcctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 26296 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcccttcgcgactac

SEQ ID NO: 26297 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcaatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26298 - DNA, 317 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatacgcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26299 - DNA, 350 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26300 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26301 - DNA, 350 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26302 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgctccaaaccctcgatccctcgctctttctcctacctcatctggcacatcatcataccctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26303 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26304 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgtccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26305 - DNA, 333 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26306 - DNA, 360 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 26307 - DNA, 409 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaggcaattcttcatctaatctaatattgattgaatgtctgagcattccgacactttcatgagaactcaagaaagcaatcccaccgcactgtttcaaacgctcgatccctcgctctttctcctacctcatctgggacatcatcatagcctcctgcttctactacgtcgccaccacttacttcccgctcctccctcaccctctctcctacttcgcctggcctctctactgggcctgccagggctgcgtcctaaccggcgtctgggtcatagcccacgagtgcggccaccacgccttcagcgactac

SEQ ID NO: 26308 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26309 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26310 - DNA, 411 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggaccggcgcacgcgctctggaggccttgctcacggtggcgggagagttgagaggtccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26311 - DNA, 308 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccggggctgcgtcctaaccggcgtctgggtcatagcccacgagtgcggccaccacgccttcagcgactac

SEQ ID NO: 26312 - DNA, 319 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcggcctaaccggcgtcggggtcatagcccacgagtgcggccaccacgccttcagcgactac

SEQ ID NO: 26313 - DNA, 411 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactcagccgaacgaccgagcgcagcgagtcagtgagcgaggaagcggaagagcgcccaatacacggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacctggcctcactactgggcctgccagggctgcgtcctaaccggcgtctgggtcatagcccacgagtgcggccaccacgccttcagcgactac

SEQ ID NO: 26314 - DNA, 352 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgacctac

SEQ ID NO: 26315 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26316 - DNA, 342 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaccatcaagcgcgtaccctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26317 - DNA, 394 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtgctgttccaggcccacggcttgaccccccagcaggtggtgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 26318 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 26319 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26320 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26321 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacagggcctgccaagggtgcgtcctaaccggcgtctgggtcatagcccacgagtgcggccaccacgccttcagcgactac

SEQ ID NO: 26322 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgagaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcaacgactac

SEQ ID NO: 26323 - DNA, 397 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagcaggtggtggccatcgccagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26324 - DNA, 350 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 26325 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26326 - DNA, 349 bp, Artificial
  Mutation in BnaA.FAD2.a introduced by TALE nuclease pair BnFAD2_T03
caggatccatgggtgcaggtggaagaatgcaagtgtctcctccctacaagaagtctgaaaccgacaacatcaaacgcgtcccctgcgagacaccacccttcactcgaacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26327 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 26328 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26329 - DNA, 341 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26330 - DNA, 350 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaacacaagaaaacaatcccaccgcactgtttcaaactctcgacccctcgctctttctcctacctcacctgggacatcatcatagcctcctgcttctactacgccgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26331 - DNA, 316 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 26332 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26333 - DNA, 371 bp, Artificial
  Mutation in BnaA.FAD2.a introduced by TALE nuclease pair BnFAD2_T03
caggatccatgggcaggtggaagaatgcaagtgtctcctccctccaagaagtctgaaaccgacaacatcaagcgcgtaccctgcgagacactgccaggcatcaaactaagcagaaggccatccgtcaaacgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26334 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctaactcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26335 - DNA, 349 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgagaactcaagaaagcaatcccaccgcactgtttcaaacgctcgatccctcgctctttctcccacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26336 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctaccgggcctgccagggctgcgtcctaacgggcctctgggtcatcgcccacgaatgcggccaccacgccttcagcgactac

SEQ ID NO: 26337 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggactgcgtcctaaccggcgtctgggtcatagcccacgagtgcggccaccacgccttcagcgactac

SEQ ID NO: 26338 - DNA, 309 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaaaccgacaacacccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 26339 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaacccaagaaagcaatcccaccgcactgtttcaaacgctcgatccctcgctctttctcctacctcatctgggacatcatcataccctcctgcttctactacgtcgccaccacttacttccctcccctccctcaccctctctcctacttcgcctggcctctctactgggcctgccagggctgcgtcctaaccggcgtctgggtcatagcccacgagtgcggccaccacgccttcagcgactac

SEQ ID NO: 26340 - DNA, 348 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26341 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaacacaagaaagcaatcccaccgcactgtttcaaacgctcgatcccacgctctttctcctacctcatctgggacatcatcatagcctcctgcttctactacgtcgccacctcttacttccctctctcccctcaccctctctcctacttcgcctggcctctctactgggcctgccagggctgcgtcctaaccggcgtctgggtcatagcccacgagtgcggccaccacgccttcagcgactac

SEQ ID NO: 26342 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcgcctggcctctctactgggcctgccagggctgcgtcctaaccggcgtctgggtcatagcccacgagtgcggccaccacgccttcagcgactac

SEQ ID NO: 26343 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatggctgcgtcctaaccggcgtctgggtcatagcccacgagtgcggccaccacgccttcagcgactac

SEQ ID NO: 26344 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctacctcaccctctctcctacctcgcctggcctctctactgggcctgccagggctgcgtcctaaccggcgtctgggtcatagcccacgagtgcggccaccacgccttcagcgactac

SEQ ID NO: 26345 - DNA, 389 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactggtttgtttgccggatcaagagctaccaactctttttccgaagaactcaagaaagcaatcccaccgcactgtttcaaacgctcgatccctcgctctttctcctacctcatctgggacatcatcatagcctcctgcttctactacgtcgccaccacttacttccctctccgccctcaccctctctcctacttcgcctggcctctctactgggcctgccagggctgcgtcctaaccggcgtctgggtcatagcccacgagtgcggccaccacgccttcagcgactac

SEQ ID NO: 26346 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26347 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacatcatcaagcgcgtaccctgcgagacaccgcccttcacgcctcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 26348 - DNA, 411 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgtacgtgccccacgagtacatcgagctgatcgagatcgcccggaacagcacccaggaccggagaactcaagaaagcaatcccaccgcactgtttcaaacgctcgatccctcgctctttctcctacctcatctgggacatcatcatagcctcctgctgctactacgtcgccaccacttacttccctcccctccctcaccctctctcccacttcgcctggcctctctactgggcctgccagggctgcgtcctaacgggcctctgggtcatagcccacgagtgcggccaccacgccttcagcgactac

SEQ ID NO: 26349 - DNA, 347 bp, Artificial
  Mutation in BnaA.FAD2.a introduced by TALE nuclease pair BnFAD2_T03
caggatccatgggtgcaggtggaagaatgcaagtgcctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26350 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgaacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26351 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26352 - DNA, 326 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccccaccgcactgtttcaaacgctcgatccctcgctctttctcctacctcatctgggacatcatcatagcctcctgcttctactacgtcgccaccacttacttccctctcctcctcaccctctctcctacttcgcctggcctctctactgggcctgccagggctgcgtcctaaccggcgtctgggtcatagcccacgagtgcggccaccacgccttcagcgactac

SEQ ID NO: 26353 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccatcgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26354 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttggcgatggccaccacctgctggggggtcaagccgtgggcctggcacagcaccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26355 - DNA, 351 bp, Artificial
  Mutation in BnaA.FAD2.a introduced by TALE nuclease pair BnFAD2_T03
caggatccatgggtgcaggtggaagaacgcaagtgtctcctccctccaagaagtctgaaaccgacaacatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26356 - DNA, 348 bp, Artificial
  Mutation in BnaA.FAD2.a introduced by TALE nuclease pair BnFAD2_T03
caggatccatgggtgcagtggaagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26357 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 26358 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26359 - DNA, 295 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26360 - DNA, 341 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 26361 - DNA, 341 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26362 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26363 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26364 - DNA, 349 bp, Artificial
  Mutation in BnaA.FAD2.a introduced by TALE nuclease pair BnFAD2_T03
caggatccatgggtgcaggtggaagaatgaaagtgtctcctccctcccaaacgtctgaaaccgacaacatcaagcgcgtaccctgcgagacaccgcccttcactgtgaactcacgaaagcaatcccaccgcactgtttcaaccgctcgatccctcgctctttctcctacctcatctgggacatcatcatagcctcctgcttctactccttcgccaccacttacttccctctcctccccccccctctctcctacttcgcctcaccactctactgggccttccagggctgcgtcctaacgtgcctcggcgtcatagcccacgagttcggccaccactccctcatcgactac

SEQ ID NO: 26365 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26366 - DNA, 422 bp, Artificial
  Mutation in BnaA.FAD2.a introduced by TALE nuclease pair BnFAD2_T03
caggatccatgggtgcaggtggcagaatgcaagtgtatactccctccaaaaagtctgaaaccgacaacatcaagcgcgtaccctgcgagacaccgcccttcactgtcggcaagcaggcgctggagacggtccagcggctgttgccggtgctgtgccaggcccacggcttgaccacggcagaactcaagaaagcaatcccaccgcactgtttcaaacgctcgatccctcgctctttctcctacctccccttcgacatcctcgtctcctcctccctctaccacctctccacagcctacttccctctcctcccccaccctctctcctacttcgcctggcctctctactgggcctgccatggctgcgtcctaaccggcgtctgggtcatagcccacgagtgcggccaccacgccttcagcgactac

SEQ ID NO: 26367 - DNA, 348 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26368 - DNA, 348 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26369 - DNA, 324 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcactgtttcaaacgctcgatccctcgctctttctcctacctcatctgggacatcatcatagcctcctgcttctactacgtcgccaccacttacttccatctcctccctcaccctctctcctacttcgcctggcctctctactgggcctgccagggctgcgtcctaaccggcgtctgggtcatagcccacgagtgcggccaccacgccttcagcgactac

SEQ ID NO: 26370 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccagggctgcgtcctaaccggcgtctgggtcatagcccacgagtgcggccaccacgccttcagcgactac

SEQ ID NO: 26371 - DNA, 341 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26372 - DNA, 350 bp, Artificial
  Mutation in BnaA.FAD2.a introduced by TALE nuclease pair BnFAD2_T03
caggatccatgggtgcaggtggcagaatgcaagtctctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26373 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtctagaactcaagaaagtaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26374 - DNA, 351 bp, Artificial
  Mutation in BnaA.FAD2.a introduced by TALE nuclease pair BnFAD2_T03
caggatccatgggtgcaggtggcagaatgcaagtgtctactcactccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 26375 - DNA, 343 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26376 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26377 - DNA, 351 bp, Artificial
  Mutation in BnaA.FAD2.a introduced by TALE nuclease pair BnFAD2_T03
caggatccatgggtgcaggtggaagaatgcaagtgtctcatccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26378 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26379 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 26380 - DNA, 350 bp, Artificial
  Mutation in BnaA.FAD2.a introduced by TALE nuclease pair BnFAD2_T03
caggatccatgggtgcaggtggaagaatgcaagtgtctcctctctccaaaaagtctgaaaccgacaacatcaagcgcgtaccctgcgagacaccgcccttcactgtagaactcaagaaagcaatcccaccgcactgtttcacacgctcgatccctcgctctttctcctacctcatctgggacatcatcatagcctcctgcttctactacgtcgcctccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26381 - DNA, 349 bp, Artificial
  Mutation in BnaA.FAD2.a introduced by TALE nuclease pair BnFAD2_T03
caggatccatgggtgcaggtcgaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccgccacgccttcagcgactac

SEQ ID NO: 26382 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 26383 - DNA, 337 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 26384 - DNA, 389 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggtttgtttgccggatcaagagctaccaactctttttccgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26385 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26386 - DNA, 398 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggcgactgccctgctgcgtaacatcgttgctgctccataacatcggagaactcaagaaagcaatcccaccgcactgtttcaaacgctcgatccctcgctctttctcctacctcatctgggacatcatcatagcctcatgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 26387 - DNA, 374 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactccagaaacccgcggctgagtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26388 - DNA, 354 bp, Artificial
  Mutation in BnaA.FAD2.a introduced by TALE nuclease pair BnFAD2_T03
caggatccatgggtgcaggtggcagaatgcaagtgtctactccctccaaaaagtctgaaaccgacaacatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccacctcgcctgcagcgactac

SEQ ID NO: 26389 - DNA, 350 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26390 - DNA, 351 bp, Artificial
  Mutation in BnaA.FAD2.a introduced by TALE nuclease pair BnFAD2_T03
caggatccatgagtgcaggtggaagaatgcaagtctctactccctccagctcccccgaaaccaaaaccctcaaacgcgtcccctgcgagacaccacccttcactctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccagggctgcgtcctaaccggcgtctgggtcatagcccacgagtgctgccaccacgccttcagcgactac

SEQ ID NO: 26391 - DNA, 417 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccggccacttcaagggcaactacaaggcccagctgaccaggctgaaccacatcaccaactgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26392 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26393 - DNA, 295 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26394 - DNA, 351 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctacgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26395 - DNA, 334 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26396 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26397 - DNA, 350 bp, Artificial
  Mutation in BnaA.FAD2.a introduced by TALE nuclease pair BnFAD2_T03
caggatccatgggtgcaggtggcagaatgcaagtctctcctccctccaaaaagtctgaaaccgacaacatcaagcgcgtaccctgcgagacaccgcccttcactccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26398 - DNA, 308 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26399 - DNA, 349 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26400 - DNA, 336 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26401 - DNA, 332 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26402 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26403 - DNA, 350 bp, Artificial
  Mutation in BnaA.FAD2.a introduced by TALE nuclease pair BnFAD2_T03
caggatccatgggtgcaggtggcagaatgcaagtgtctcatccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26404 - DNA, 341 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26405 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26406 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacctcaagcgcgtaccctgcgagacaccgcccttcactgtcagaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26407 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccagggctgcgtcctaacgggcgtctgggtcatagcccacgagtgcggccaccacgccttcagcgactac

SEQ ID NO: 26408 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaataaagcaatcccaccgcactgtttcaaacgctcgatccctcgctctttctcctacctcatctgggacatcatcatagcctcctgcttctactacgtcgccaccacttacttccctctcctccctcaccctctatcctacttcgcctggcctctctactgggcctgccagggctgcgtcctaaccggcgtctgggtcatagcccacgagtgcggccaccacgccttcagcgactac

SEQ ID NO: 26409 - DNA, 349 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26410 - DNA, 317 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatacgcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26411 - DNA, 381 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgaggcatttctgtcctggctggtctagaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26412 - DNA, 319 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccccttacttccctctcctccctcaccctctctcctccttcgcctggcctctctactgggcctgccagggctgcgtcctaacgggcctctgggtcatagcccacgagtgcggccaccacgccttcagcgactac

SEQ ID NO: 26413 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26414 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26415 - DNA, 432 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagcggctgttgccggtgctgtgccaggcccacggcttgaccccggagcaggtggtggccatcgccagccacgatggcggtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26416 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 26417 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26418 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 26419 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26420 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgacggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 26421 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26422 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctcattctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 26423 - DNA, 350 bp, Artificial
  Mutation in BnaA.FAD2.a introduced by TALE nuclease pair BnFAD2_T03
caggatccatgggtgcagggggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 26424 - DNA, 356 bp, Artificial
  Mutation in BnaA.FAD2.a introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctcggcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26425 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26426 - DNA, 339 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26427 - DNA, 339 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26428 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacctcaagcgcgtaccctgcgagacaccacccttcactgtcagaactcaagaaagcaatcccaccgcactgttccaaacgctcgatccctctctctttctcctacctcatctgggacatcatcatagcctcctgcttctactacgtcgccaccacttacttccctcccctccctcaccctctctcctacctcgcctggcccctctactgggcctgccaaggctgcgtcctaacgggcctctgggtcatagcccacgagtgcggccaccacgccttcagcgactac

SEQ ID NO: 26429 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26430 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26431 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccagcgtctgggtcatagcccacgagtgcggccaccacgccttcagcgactac

SEQ ID NO: 26432 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26433 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactaactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 26434 - DNA, 411 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggcctggcacagcaccggcaacagccgctggaccgtctccagcgcctgcttgccaccattagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26435 - DNA, 350 bp, Artificial
  Mutation in BnaA.FAD2.a introduced by TALE nuclease pair BnFAD2_T03
caggatccatgggtgcagtcggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26436 - DNA, 343 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgccttcagcgactac

SEQ ID NO: 26437 - DNA, 348 bp, Artificial
  Mutation in BnaA.FAD2.a introduced by TALE nuclease pair BnFAD2_T03
caggatccatgggtgcaggtcgaagaatgcaagtctctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttgcttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26438 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26439 - DNA, 348 bp, Artificial
  Mutation in BnaA.FAD2.a introduced by TALE nuclease pair BnFAD2_T03
caggatccatgggtgcaggtggcagaatgcaagtgtatactctctccaaaaagtctgaaaccgacaccataaagcgcgtaccctgcgagacaccgcccttcactgtaactcaagaaagcaatcccaccgcactgtttcaaacgctcgatccctcgctctttctcctacctcatctgggacatcatcatagcctcctgcttctactacggcgccaccacttacttccctctcctccctcaccctctctcctacttcgcctggcctcactactgggcctgccagggctgcgtcctgaccggcgtctgggtcatagcccacgagtgcgtccaccacgccttcagcgactac

SEQ ID NO: 26440 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 26441 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 26442 - DNA, 344 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26443 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 26444 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26445 - DNA, 280 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26446 - DNA, 407 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgtggacaccaaggcctactccggcggctacaacctgcccatcggccacgccgacgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26447 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcgagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 26448 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26449 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 26450 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccaccgcactgtttcaaacgctagatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26451 - DNA, 349 bp, Artificial
  Mutation in BnaA.FAD2.a introduced by TALE nuclease pair BnFAD2_T03
caggatccatgggtgcaggtggaagaatgcaaatgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26452 - DNA, 345 bp, Artificial
  Mutation in BnaA.FAD2.a introduced by TALE nuclease pair BnFAD2_T03
caggatccatgggttcaggtggaagaatgcaagtctctcctccctccagctcccccggaaccaacaccctcaaacgcgtcccctgcgagacaccaccattcacacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26453 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26454 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26455 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26456 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26457 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaaacgcgtaccctgcgagacaccgcccttcactttgctccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26458 - DNA, 409 bp, Artificial
  Mutation in BnaA.FAD2.a introduced by TALE nuclease pair BnFAD2_T03
caggatccatgggtgcaggtggcagaatgcaagtgtctcctccatccaaaaagtctgaaaccgacaacatcaagcgcgtaccctgcgagacaccgcccttcactgttgcactgacgggtgccccgctcaacttgaccccccagcaggtggtggccatcgccagcaataatggtggcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26459 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatatcccacgagtgcggccaccacgccttcagcgactac

SEQ ID NO: 26460 - DNA, 393 bp, Artificial
  Mutation in BnaA.FAD2.a introduced by TALE nuclease pair BnFAD2_T03
caggatccatgggtgcaggtggaagaatgcaagtgtatccaccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgcccccacttacttccctctcctccctccccctctctccttcttcgcctggcctctctactgggcctgccagggctgcgtcctaaccggcgtctgtgtctttgcccacgagtgcggcctccacgccttcagcgactac

SEQ ID NO: 26461 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 26462 - DNA, 277 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26463 - DNA, 348 bp, Artificial
  Mutation in BnaA.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26464 - DNA, 349 bp, Artificial
  Mutation in BnaA.FAD2.a introduced by TALE nuclease pair BnFAD2_T03
caggatccatgggtgcaggtggaagaatgcaagtctctcctccctcccgctcccccgaaaccaaaaccctcaaacgcgtcccctgcgagacaccacccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26465 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 26466 - DNA, 350 bp, Artificial
  Mutation in BnaA.FAD2.a introduced by TALE nuclease pair BnFAD2_T03
caggatccatgggtgcagctcgcagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26467 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 26468 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgctaagggtgcgtcctaaccggcgtctgggtcatagcccacgagtgcggccaccacgccttcagcgactac

SEQ ID NO: 26469 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 26470 - DNA, 351 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcataccctcctgcttctactacgtcgccaccacttacttccctcccctccctcaccctctctcctacttcgcctagcctctctactgggcctgccagggctgcgtcctaaccggcgtctgggtcatagcccacgagtgcggccaccacgccttcagcgactac

SEQ ID NO: 26471 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 26472 - DNA, 304 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgcccgatccctcgctctttctcctacctcatctgggacatcctcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 26473 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtccgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagctcacgagtgcggccaccacgccttcagcgactac

SEQ ID NO: 26474 - DNA, 402 bp, Artificial
  Mutation in BnaA.FAD2.a introduced by TALE nuclease pair BnFAD2_T03
caggatcctgggtcaggtggaagaatgccagtctctcctccctccagctcccccgaaaccaaaaccctcaaacgcgtcccctgcgagacaccacccttcactctcgcaattaatacgcgtaccgctagccagtaagagtttgtagaaacgcaaaacggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26475 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgctactactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26476 - DNA, 351 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26477 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26478 - DNA, 308 bp, Artificial
  Mutation in BnaA.FAD2.a introduced by TALE nuclease pair BnFAD2_T03
caggatccatgggtgcaggtggaagaatgcaagtgtctcatccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 26479 - DNA, 463 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggcgatggcggcaagcaggcgctggagacggtccagcggctgttgccggggctgtgccaggcccacggcttgaccccggagcaggtggtggccatcgccagcaataatggtgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26480 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacctccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26481 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacatcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26482 - DNA, 347 bp, Artificial
  Mutation in BnaA.FAD2.a introduced by TALE nuclease pair BnFAD2_T03
caggatccatgggtgcaggtggaagaatgtaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26483 - DNA, 343 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtttggaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26484 - DNA, 467 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcggatggccttctgcttagtttgatgcctggcagtttatggcgggcagggggtggggtccgatcccatgaagacaaacgacatagtgactaagcgcgaactgcaatttggagaatggcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26485 - DNA, 334 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 26486 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 26487 - DNA, 346 bp, Artificial
  Mutation in BnaA.FAD2.a introduced by TALE nuclease pair BnFAD2_T03
caggatccatgggtgcaggtggcagaatgcaagtctctcctccctccaagaagtctgaaaccgacaccatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26488 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26489 - DNA, 324 bp, Artificial
  Mutation in BnaA.FAD2.a introduced by TALE nuclease pair BnFAD2_T03
caggatccatgggtgcaggtggaagaatgcaagtttctcctccctccaaaaagtctgaaaccgacaacatcaagcgcgtaccctgcgagacaccgcccttcactgcactgtttcaaacgctcgatccctcgctctttctcctacctcatctggtacatcatcatagcctcctgcttctactacgtcgccaccacttacttccctctcctccctccccctctctcctacttcgcctggcctctctactgggcctgccaagggtgcgtcctaaccggcgtctgggtcatagcccacgagtgcggccaccacgccttcagcgactac

SEQ ID NO: 26490 - DNA, 354 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccttccagggctgcgtcctaaccggcgtctgggtcatagcccacgagtgcggccaccacgccttcagcgactac

SEQ ID NO: 26491 - DNA, 349 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggcccccacgccctcagcgactac

SEQ ID NO: 26492 - DNA, 381 bp, Artificial
  Mutation in BnaA.FAD2.a introduced by TALE nuclease pair BnFAD2_T03
caggatccatgggtgcggtggaagaatgcaagtgtctcctccctccaaaaagtctgaaaccgacaccatcaagcgcgtaccctgcgagacaccgcccttcactgtacagccgctggaccgtctccagcgcctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26493 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctcccccaccctctcccttacctcgcctggcccctctactgggcctgccaagggtgcgtcctaacgggcctctgggtcatcgcccacgaatgcggccaccacgccttcagcgactac

SEQ ID NO: 26494 - DNA, 350 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcatggcctctctactgggcctgccagggctgcgtcctaaccggcgtctgggtcatagcccacgagtgcggccaccacgccttcagcgactac

SEQ ID NO: 26495 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26496 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctcttggtcatcgcccacgaatgcggccaccacgccttcagcgactac

SEQ ID NO: 26497 - DNA, 402 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26498 - DNA, 350 bp, Artificial
  Mutation in BnaA.FAD2.a introduced by TALE nuclease pair BnFAD2_T03
catgatccatgggtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26499 - DNA, 358 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 26500 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 26501 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgacccaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26502 - DNA, 350 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26503 - DNA, 343 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26504 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 26505 - DNA, 346 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26506 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26507 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26508 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccccgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26509 - DNA, 338 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcaagaaagcaagcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26510 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26511 - DNA, 467 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactacggatggccttctgcttagtttgatgcctggcagtttatggcgggcaggggaggggggccgatccaatgaagacaatagacatagtgactaaaagcgaaatgcaaattggagaatggcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26512 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgccaggcccacggcttgaccccggagcaggtggtggccatcgcgtcgattttgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26513 - DNA, 307 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctcagcgactac

SEQ ID NO: 26514 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26515 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26516 - DNA, 343 bp, Artificial
  Mutation in BnaA.FAD2.a introduced by TALE nuclease pair BnFAD2_T03
caggatccatgggtgcaggtggaagaatgcaagtgcctcctccatccaagaagtctgaaaccgacaccatcaagcgcgtaccctgcgaaacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaacgggcctctgggtcatagcccacgagtgcggccaccacgccttcagcgactac

SEQ ID NO: 26517 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 26518 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26519 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26520 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26521 - DNA, 371 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26522 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgccctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26523 - DNA, 279 bp, Artificial
  Mutation in BnaA.FAD2.a introduced by TALE nuclease pair BnFAD2_T03
caggatccatgggtgcaggtggaagaatgcaagtctctcctccctccagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26524 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatgggtgcgtcctaaccggcgtctgggtcatagcccacgagtgcggccaccacgccttcagcgactac

SEQ ID NO: 26525 - DNA, 351 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatatcccacgagtgcggccaccacgccttcagcgactac

SEQ ID NO: 26526 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26527 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26528 - DNA, 383 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaacgaccttttggaaacttcggcttcccctgaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26529 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26530 - DNA, 399 bp, Artificial
  Mutation in BnaA.FAD2.a introduced by TALE nuclease pair BnFAD2_T03
caggatccatgggtgcaggtggcagaatgcaagtgtctactccctccaaaaagcctgaaaccgacaacatcaagcgcgtaccctgcgagacaccgcccttcactgtcgggcgactgccctgctgcgtaacatcgttgctgctccataacatcggagaactcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactgc

SEQ ID NO: 26531 - DNA, 343 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcacgactac

SEQ ID NO: 26532 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacatcatctgggacatcatcatagcctcctgcttctactacgtcgccaccacttacttccctctcatccctcaccctctctcctacttcgcctggcctctctactgggcctgccagggctgcgtcctaaccggcgtctgggtcatagcccacgagtgcggccaccacgccttcagcgactac

SEQ ID NO: 26533 - DNA, 345 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26534 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 26535 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 26536 - DNA, 280 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26537 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgccaggcccacggcttgaccccggagcaggtggtggccatcgcgtcgattttgtagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgggcctgccaagggtgcgtcctaaccggcgtctgggtcatagcccacgagtgcggccaccacgccttcagcgactac

SEQ ID NO: 26538 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26539 - DNA, 353 bp, Artificial
  Mutation in BnaA.FAD2.a introduced by TALE nuclease pair BnFAD2_T03
caggatatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26540 - DNA, 349 bp, Artificial
  Mutation in BnaA.FAD2.a introduced by TALE nuclease pair BnFAD2_T03
caggatccatgggtgcaggtgcaagaatgcaagtgtctcctcactcccaagagtctgaaaccgacagcatcaagcgcgtaccctgcgagacaccgcccttcactccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggcatagcccaccagtgcggccaccacgcctgcagcgactac

SEQ ID NO: 26541 - DNA, 350 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26542 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccagggctgcgtcctaacgggcctctgggtcatagcccacgagtgcggccaccacgccttcagcgactac

SEQ ID NO: 26543 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26544 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26545 - DNA, 346 bp, Artificial
  Mutation in BnaA.FAD2.a introduced by TALE nuclease pair BnFAD2_T03
caggatccatgggtgcaggtggaagaatgcaagtgtctactccctccaaaaagcctgaaaccgacaacataaagcgcgtaccctgagagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagctctcgagtgcggccaccacgccttcagcgactac

SEQ ID NO: 26546 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctaccaagggtgcgtcctaaccggcgtctgggtcatagcccacgagtgcggccaccacgccttcagcgactac

SEQ ID NO: 26547 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26548 - DNA, 345 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26549 - DNA, 350 bp, Artificial
  Mutation in BnaA.FAD2.a introduced by TALE nuclease pair BnFAD2_T03
caggattcatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 26550 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaccggcgtctgggtcatagcccacgagtgcggccaccacgccttcagcgactac

SEQ ID NO: 26551 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccggggctgcgtcctaaccggcgtctgggtcatagcccacgagtgcggccaccacgccttcagcgactac

SEQ ID NO: 26552 - DNA, 419 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttggggggtcaagccgtgggcctggcacagcaccggcaacagccgctggaccgtctccagcgcctgcttgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26553 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttggaagcaatcccaccgaactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26554 - DNA, 351 bp, Artificial
  Mutation in BnaA.FAD2.a introduced by TALE nuclease pair BnFAD2_T03
caggatccatgggtgcaggtggaagaatgcaagtgtctccgccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26555 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26556 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 26557 - DNA, 351 bp, Artificial
  Mutation in BnaA.FAD2.a introduced by TALE nuclease pair BnFAD2_T03
caggatccatgggtgcaggtggaagaatgcaagtgcctcctccctccaaaaagactgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcgcacgagtgcggccaccacgccttcagcgactac

SEQ ID NO: 26558 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26559 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26560 - DNA, 331 bp, Artificial
  Mutation in BnaA.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26561 - DNA, 342 bp, Artificial
  Mutation in BnaA.FAD2.a introduced by TALE nuclease pair BnFAD2_T03
caggatccatgggtgcaggtggaagaatgcaagtgtctactccctcccaaaagtctgaaaccgacaaaatcaagcgcggaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26562 - DNA, 350 bp, Artificial
  Mutation in BnaA.FAD2.a introduced by TALE nuclease pair BnFAD2_T03
caggatccatgggtgcaggtgcaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26563 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26564 - DNA, 351 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26565 - DNA, 341 bp, Artificial
  Mutation in BnaA.FAD2.a introduced by TALE nuclease pair BnFAD2_T03
caagatccatgggtgcaggtggaagaatgcaagtgtctcctccctccaaaaagtctgaaaccgacaacatcaagcgcgtaccctgcgagacaccgcccttcactgtcggggagaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 26566 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccggcctctctactgggcctgccaagggtgcgtcctaaccggcgtctgggtcatagcccacgagtgcggccaccacgccttcagcgactac

SEQ ID NO: 26567 - DNA, 413 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccataccggccaccacctgctggggggtcaagccgtgggcctggcacagcaccggcaacagccgctggaccggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26568 - DNA, 410 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacaggcccacggcttgaccccccagcaggtggtggccatcgccagcaataatggtggcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26569 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26570 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcataagaactcaagaaagcaatcccaccgcactgtttcaaacgctcgatccctcgctctttctcctacctcatctgggacatcatcatagcctcctgcttctactacatcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26571 - DNA, 352 bp, Artificial
  Mutation in BnaA.FAD2.a introduced by TALE nuclease pair BnFAD2_T03
caggatccatgggtgcagttggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctttcagcgactac

SEQ ID NO: 26572 - DNA, 350 bp, Artificial
  Mutation in BnaA.FAD2.a introduced by TALE nuclease pair BnFAD2_T03
caggatccatgggtgcaggtggaagaatgcaagtgtctcctccctccaataagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgacagggctgcgtcctaaccggcgtctgggtcatagcccacgagtgcggccaccacgccttcagcgactac

SEQ ID NO: 26573 - DNA, 396 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggttcctggccttttgctggccttttgctcacatgttctttccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 26574 - DNA, 335 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgagaactcaagaaagcaatcccaccgcactgtttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 26575 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26576 - DNA, 350 bp, Artificial
  Mutation in BnaA.FAD2.a introduced by TALE nuclease pair BnFAD2_T03
caggatccatgggtgcaggtggcagaatgcaagtgtctactccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatatcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26577 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 26578 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggtcctgccaagggtgcgtcctaaccggcgtctgggtcatagcccacgagtgcggccaccacgccttcagcgactac

SEQ ID NO: 26579 - DNA, 442 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttcgccagccacgatggcggcaagcaggcgctggagacggtccagcggctgttgccggtgctgtgccaggcccacggcttgaccccccagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26580 - DNA, 347 bp, Artificial
  Mutation in BnaA.FAD2.a introduced by TALE nuclease pair BnFAD2_T03
caggatccatgggtgcaggtggaagaatgcaagtctctcctccctccaaaaagcctgaaaccgacaacatcaagcgcgtaccctgcgagacaccgcccttcacagaactcaagaaagcaatcccaccgcactgtttcaaacgctcgatcccccgctctttctcctacctcatctgggacatcatcatagcctcctgcttctactacgtcgccaccgcttacttccctctcctccctcaccctctctcctacctcgcctggcccctctactgggcctgccaagggtgcgtcctaaccggcgtctgggtcatagcccacgagtgcggccaccacgccttcagcgactac

SEQ ID NO: 26581 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcccgccaagggtgcgtcctaaccggcgtctgggtcatagcccacgagtgcggccaccacgccttcagcgactac

SEQ ID NO: 26582 - DNA, 356 bp, Artificial
  Mutation in BnaA.FAD2.a introduced by TALE nuclease pair BnFAD2_T03
caggatccatgggtgcaggtggaagaatgcaagtgcctcctccctccaaaaagtctgaaaccgacaacatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 26583 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26584 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctagctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26585 - DNA, 446 bp, Artificial
  Mutation in BnaA.FAD2.a introduced by TALE nuclease pair BnFAD2_T03
caggatccatgggtgcaggtggaagaatgcaagtctctcctccctccaggtcccccggaaccaacaccctcaaacgcgtcccctgcgagacaccaccattcacggcgatggccaccacctgctccggggtcaagccgtgggcctggcacactccgggccgctgcttcacaacgttcaaatccgctcccggcggatttgtcctagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26586 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26587 - DNA, 341 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26588 - DNA, 340 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26589 - DNA, 372 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgctcacatgttctttcctgcgttatcccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26590 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26591 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26592 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26593 - DNA, 444 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgtgggcctggcacagcaccggcaacagcacctgcaccgtctccagcgctggtttgccaccaatattgctggcgatggccaccacctgctacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26594 - DNA, 328 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 26595 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgtctggcccctctactgggcctgccagggctgcgtcctaaccggcgtctgggtcatagcccgcgagtgcggccaccacgccttcagcgactac

SEQ ID NO: 26596 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 26597 - DNA, 402 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcgggttcatagcccacaagtgcggccaccacgcctgcagcgactac

SEQ ID NO: 26598 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctagctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26599 - DNA, 304 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcaatcccaccgcactgtttcaaacgcttgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 26600 - DNA, 309 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaaccgacaacacccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26601 - DNA, 309 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26602 - DNA, 316 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26603 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26604 - DNA, 349 bp, Artificial
  Mutation in BnaA.FAD2.a introduced by TALE nuclease pair BnFAD2_T03
caggacccatgggtgcaggtggaagaatgcaagtgtctcctgcctccaaaaagtctgaaaccgacaacatcaagcgcgtaccctgcgagacaccgcccttcactgagaactcaagaaagcaatcccaccgcactgtttcaaacgctcgatccctcgctctttctcctacctcagctgggacatcatcatagcctcctgcttctactacgtcgccaccacttacttccctctcctccctcaccctctctcctacttcccctggcctctctactgggcctgccagggctgcgtcctaaccggcgtctgggtcatagcccacaagtgcggccaccacgccatcagcgactac

SEQ ID NO: 26605 - DNA, 352 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcggccaccacgccttcagcgactac

SEQ ID NO: 26606 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26607 - DNA, 352 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26608 - DNA, 316 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 26609 - DNA, 308 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctaatacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26610 - DNA, 345 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26611 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctagatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 26612 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26613 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26614 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaaccctgaaaccgacaacatcaagcgcgtaccctgcgagacaccgcccttcactgtagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26615 - DNA, 347 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26616 - DNA, 347 bp, Artificial
  Mutation in BnaA.FAD2.a introduced by TALE nuclease pair BnFAD2_T03
caggatccatgggtgcaggtggcagaatgcaagtgtctcctccctcccagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26617 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggccactctactgggcctgccagggcggcgtcctaaccggcgtctgggtcatagcccacgagtgcggccaccacgccttcagcgactac

SEQ ID NO: 26618 - DNA, 470 bp, Artificial
  Mutation in BnaA.FAD2.a introduced by TALE nuclease pair BnFAD2_T03
caggatccatgggtgcaggtggaagaatgtaagtgtctcctccctccaaaaagtctgaaaccgacaacatcaagcgcgtaccctgcgagacaccgcccttcactgtcagccgctggaccgtctccagcgcctgcttgccaccgccattgctggcgatggccaccacctgctggggggtcaagccgtgggccagccacgatggcggcaagcaggcgctggagatcggagaactcaagaaagcaatcccaccgcactgtttcaaacgctcgatccctcgctctttctcctacctcatctggaacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26619 - DNA, 413 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggatgggatccgatccaatgaagacaatcgacatagtgactggatatgttgtgttttacagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 26620 - DNA, 351 bp, Artificial
  Mutation in BnaA.FAD2.a introduced by TALE nuclease pair BnFAD2_T03
caggatccatgggtgcaggcggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 26621 - DNA, 382 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgagcggggcacccgtcagtgcattgcgccagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26622 - DNA, 341 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccagaactcaagaaagcaatcccaccgcactgtttcaaacgctcgatccctcgctctttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26623 - DNA, 440 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccccccagcaggtggtggccatcgccagcaatggcggtggcaagcaggcgctggagacggtccagcggctgttgccggtgctgtgccaggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26624 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 26625 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26626 - DNA, 407 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtggacaccaaggcctactccggcggctacaacctgcccatcggccaggccgacgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26627 - DNA, 338 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26628 - DNA, 422 bp, Artificial
  Mutation in BnaA.FAD2.a introduced by TALE nuclease pair BnFAD2_T03
caggatccattggtgcaggtggaagaatgcaagtgtctcctccctccaagaagtctgaaaccgacaacatcaagcgcgtaccctgcgagacaccgcccttcactgtcggctggcgatggccaccacctgctccggggtcaagccgtgggcctggcacagcaccggcaagcaggcgctggagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26629 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26630 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26631 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26632 - DNA, 349 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26633 - DNA, 377 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtccccctgcgagacaccacaccgcccgccataaactgccaggcatcaaacagcggagaactcaagaaagcaatcccaccgcactgtttcaaacgctcgattcctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26634 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtagaactcaagaaagcaatcccaccgcactgtttcaaacgctcgatccctcgcgctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 26635 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26636 - DNA, 460 bp, Artificial
  Mutation in BnaA.FAD2.a introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcactctcgggggtcaagcggctccgcccccctgacgagcgtcgatttaaagactgggcctttcgttttatctgttgtttgtcggtgaacgctctcctgagtaggacaaatccgcgcccacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggcctccacgccttcagcgactac

SEQ ID NO: 26637 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 26638 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 26639 - DNA, 347 bp, Artificial
  Mutation in BnaA.FAD2.a introduced by TALE nuclease pair BnFAD2_T03
caggatccatgggtgcaggcggaagaatgcaagtgtctgctgcatccaaaaagtctgaaaccgacaacatcaagcgcgtaccctgcgagacaccgcccttcactaacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccagggctgcgtcctaaccggcgtctgggtcatagcccacgagtgcggccaccacgccttcaacgactac

SEQ ID NO: 26640 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26641 - DNA, 381 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttcgaggcatttctgccctggctggtctagaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26642 - DNA, 341 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26643 - DNA, 372 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgctcacatgttctttcctgcgttatcccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26644 - DNA, 350 bp, Artificial
  Mutation in BnaA.FAD2.a introduced by TALE nuclease pair BnFAD2_T03
caggatccatgggtgcaggtggaagaatgcaagtgactcctccctccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26645 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26646 - DNA, 359 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggatcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26647 - DNA, 351 bp, Artificial
  Mutation in BnaA.FAD2.a introduced by TALE nuclease pair BnFAD2_T03
caggatccatgggtgcaggtgggagaatgcaagtgtctcctccctccaaaaagtctgaaaccgacaacatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26648 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccagggctgcgtcctaaccggcgtctgggtcatagcccacgagtgcggcccccacgccttcagcgactac

SEQ ID NO: 26649 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26650 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaaccttcggtttgatcttctcctgttgctcggctatgtgccaggccatgctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26651 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccctcaagcgcgtaccctgcgagacaccgcccttcactgagaactcaagcaagcaatcccaccacactgtttccaacgctcgatccctcgcgctttctcctacctcatctgggacatcatcatatcctcctgcttctactccgacgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 26652 - DNA, 348 bp, Artificial
  Mutation in BnaA.FAD2.a introduced by TALE nuclease pair BnFAD2_T03
caggatccatgggtgcaggtggaagaatgcaagtgtcttctccctcccagaagtctgaaaccgacaccatcaagcgcgtaccctgcgagacaccgcccttcactgtagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggtcctgccagggctgcgtcctaaccggcgtctgggtcatagcgctcgagtgcggccaccacgccttcagcgactac

SEQ ID NO: 26653 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26654 - DNA, 349 bp, Artificial
  Mutation in BnaA.FAD2.a introduced by TALE nuclease pair BnFAD2_T03
caggatccatgggtgcaggtggaagaatgcaagtctctcatccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26655 - DNA, 358 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26656 - DNA, 398 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggcgactgccctgctgcgtaacatcgttgctgctccataacatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26657 - DNA, 409 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgcactgacgggtgccccgctcaacttgaccccccagcaggtggtggccatcgccagcaataatggtggcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26658 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaaccttcggtttgatcttctcctgttgctcggctatgtgccaggccatgctagaactcaagaaagcaatcccaccgcactgtttcaaacgctcgatccctcgctctttctcctacctcatctgggacatcatcatagcctcctgcttctactacgtcgccactacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 26659 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 26660 - DNA, 354 bp, Artificial
  Mutation in BnaA.FAD2.a introduced by TALE nuclease pair BnFAD2_T03
caggatccatgggtgcaggtggaagaatgcaagcctctcctccctccagctcccccggaaccaacaccctcaaacgcgtcccctgcgagacaccacccttcactctcgggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26661 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 26662 - DNA, 433 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggtggcaagcaggcgctggagacggtccagcggctgttgccggtgctgtgccaggcccacggcttgaccccccagcaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26663 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgcccgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccactccttcagcgactac

SEQ ID NO: 26664 - DNA, 349 bp, Artificial
  Mutation in BnaA.FAD2.a introduced by TALE nuclease pair BnFAD2_T03
caggatccattggtgcaggtggaagaatgcaagtgtcacctccctcaaagaagtctgaaaccgacaccatcaagcgcgtaccctgcgagacaccacccttcactcttacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggactgccagggctgcgtcctaacgggcctcggggtcatcgcccacgaatgcggccaccacgccttcagcgactac

SEQ ID NO: 26665 - DNA, 350 bp, Artificial
  Mutation in BnaA.FAD2.a introduced by TALE nuclease pair BnFAD2_T03
caggatccatgggtgcaggtggcaggatgcaagtgtctcctccctccaaaaagcctgaaaccgacaacataaagagcgtaccctgcgagacaccgcccttcactccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtgctagccggcttctgggtcatagcccacgagtgcggccaccacgcctgtatcgactac

SEQ ID NO: 26666 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26667 - DNA, 324 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaagcgcgtaccctgcgagacaccgcccttcactgcactgtttcaaacgctcgatccctcgctctttctcctaccccatctggtacatcatcatatcctcctgcttctactacgacgccaccacctacttctctctcctccctcaccctctctcctacttcgcctggcctctctactgggcctgccagggctgcgtcctaaccggcgtctgggtcatagcccacgagtgcggccaccacgccttcagcgactac

SEQ ID NO: 26668 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26669 - DNA, 356 bp, Artificial
  Mutation in BnaA.FAD2.a introduced by TALE nuclease pair BnFAD2_T03
caggatccatggtgcaggtggaagaatgcaagtgtctcctccctccaaaaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26670 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26671 - DNA, 409 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaggcaattcttcatctaatctaatattgattgaatgtctgagcattccgacactttcatgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26672 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctaactcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26673 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcttaaccggcgtctgggtcatagcccacgagtgcggccaccacgcctgcagcgactac

SEQ ID NO: 26674 - DNA, 343 bp, Artificial
  Mutation in BnaA.FAD2.a introduced by TALE nuclease pair BnFAD2_T03
caggatccatggtgcaggtggaagaatgcaagtgtctcctccctccaaaaagtctgaaaccgacaacatcaagcgcgtaccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26675 - DNA, 377 bp, Artificial
  Mutation in BnaA.FAD2.a introduced by TALE nuclease pair BnFAD2_T03
caggatccatgggtgcaggtggaagaatgcaagtcactactccctccagctcccccgaaaccaaaaccctcaaacgcgtcccccggcgagccaccacaacgcccgccataaactgccagacagcaaacagcagggacctcaagaaagcaaccccaccacactatttcaaacgctcgatccctcgcactttctcctacctcatctgggacatcatcataaccacctgcttctactacgtcgcccccgcttacttccctcccctccctcaccctctctcctacttcgcctggcctctctactgggcctgccagggctgcgtcctaacgggcgtctgggtcatagcccacgagtgcggccaccacgccgtcagcgactac

SEQ ID NO: 26676 - DNA, 392 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtaatctggaacatcgtatgggtaatcgatgaccttacgtttaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26677 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26678 - DNA, 349 bp, Artificial
  Mutation in BnaA.FAD2.a introduced by TALE nuclease pair BnFAD2_T03
caggatccatgggtgcaggtggaacaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgtgacatcatcatagcctcctgcttctactacgtcgccaccacttacttccctctcctccctcaccctctcccctacttcgcctggcctctctactgggcctgccagggctgcgtcctaaccggcgtctgggtcatagcccacgagtgcggccaccacgccttcagcgactac

SEQ ID NO: 26679 - DNA, 419 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcccacggcttgaccccccagcaggtggtggccatcgccagcaataatggtggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26680 - DNA, 304 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 26681 - DNA, 349 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgcccgggctgcgtcctaaccggcgtctgggtcatagcccgccagtgcggccaccacgccttcagccactac

SEQ ID NO: 26682 - DNA, 318 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgccctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 26683 - DNA, 295 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26684 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagaaatcccacctcactgtttcaaacgctcgatccctcgctctttctcctacctcatctgggacatcatcatagcctcctgcttctactacgtcgccaacacttacttccctctcatccctcaccctctctcctacttcgcctggcctctctactgggcctgccagggctgcgtcctaaccggcgtctgggtcatagcccacgagtgcggccaccacgccttcagcgactac

SEQ ID NO: 26685 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26686 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaacaaaaaccctcaaacgcgtcccctgcgagacaccacccttcactctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26687 - DNA, 319 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26688 - DNA, 380 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26689 - DNA, 442 bp, Artificial
  Mutation in BnaA.FAD2.a introduced by TALE nuclease pair BnFAD2_T03
caggatccatgtgtgcaggtggaagaatgcaagtgtctcctccctccaaaaagtctgaaaccgacaacatcaagcgcgtaccctgcgagacaccgcccttcactgtcggcggctgttgccggtgctgtgccaggcccacggcttgaccccggagcaggtggtggccatcgccagcaatattggtggcaagcaggcgctggagacggtgcaggagaactcaagaaagcaatcccaccgcactgtttcaaacgctcgatccctcgctctttctcctcttcgacatcatcacctcctcctcggctcctccccctaccacctctccacagcctacttccctctcccttacctcgcctgacccctctactgcgcctgccaaggctgcgtcctaacgggcctctgggtcatagcccacgagtgcggccaccacgccttcagcgactac

SEQ ID NO: 26690 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttcttctacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26691 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26692 - DNA, 351 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaacagacaacatcaagcgagtaccctgcgagacaccgcccttcactgggagaactcaagaaagcaatcccaccgcactgtttcaaacgctcgatccctcgcgctttctcctacctcatctgggacatcatcatagcctcctgcttctactacgtcgccaccacttacttccctctcctccctcaccctctctcctacttcgcctggcctctctactgggcctgccaagggtgcgtcctaaccggcttctgggtcattgcccacgagtgcggccaccacgccttcagccactac

SEQ ID NO: 26693 - DNA, 350 bp, Artificial
  Mutation in BnaA.FAD2.a introduced by TALE nuclease pair BnFAD2_T03
caggatccatgggtgcaggtggaagaatgcaagtgtcacctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 26694 - DNA, 457 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctcggagaagaaatccgagttgaggcacaagctgaagtacgtgccccacgagtacatcgagctgatcgagatcgcccggaacagcacccaggaccgtatcctggagatgaaacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26695 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaacaccctcaaacgcgtcccctgcgagacaccacccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26696 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26697 - DNA, 348 bp, Artificial
  Mutation in BnaA.FAD2.a introduced by TALE nuclease pair BnFAD2_T03
caggatccatgtgtgcaggtggaagaatgcaagtgtctcctccctccaaaaagtctgaaaccgacaccatcaagcgcgtaccctgcgagacaccgcccttcactgtagctcaagaaaacaatcccaccgcactgtttcaaacgctcgacccctcgctcttacgcctacctccgccgccacctcatcagagcctcctgcttctactacgtcgccaccacttgcttccctctccgccctccccccctctccttcctcgcccggcctctctactgctcctgccaggcctgcgtcctacccggcgtctgggtcatacctctacagtgcggccaccacgccttcagcgactac

SEQ ID NO: 26698 - DNA, 348 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26699 - DNA, 350 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaacctcaagcgcgtaccctgcgagacaccgcccttcactgtagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgagtgcggccaccacgccttcagcgactac

SEQ ID NO: 26700 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctagctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26701 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26702 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26703 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26704 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcatgccagggctgcgtcctaaccggcgtctgggtcatagcccacgagtgcggccaccacgccttcagcgactac

SEQ ID NO: 26705 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctcaccggcgtctgggtcatagcccacgagtgcggccaccacgccttcagcgactac

SEQ ID NO: 26706 - DNA, 348 bp, Artificial
  Mutation in BnaA.FAD2.a introduced by TALE nuclease pair BnFAD2_T03
caggatccatgggtgcaggtggaagaatgcaagtgcctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcataacgggcctctgggtcatcgcccacgaatgcggccaccacgccttcagcgactac

SEQ ID NO: 26707 - DNA, 409 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaggcaattcttcatctaatctaatattgattgaatgtctgagcattccgacactttcatgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 26708 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccatagacctcaagaaagcaatcccacctcactgcttcaaacgctcgatccctcgctctttctcctacctcatctgggacatcatcatagcctcctgcttctaccacctctccacagcctacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 26709 - DNA, 314 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26710 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgctcacgaatgcggccaccacgccttcagcgactac

SEQ ID NO: 26711 - DNA, 408 bp, Artificial
  Mutation in BnaA.FAD2.a introduced by TALE nuclease pair BnFAD2_T03
caggatccatgggtgcaggtggcagaatgcaagtctctcctccctccaaaaagtctgaaaccgacaacatcaagcgcgtacactgcgagacaccgcccttcactgtcggcaagcaggcgctggagacggtccagcggctgttgccggtgctgtgccaggcccacggcttgaccacggcagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggcggcgtcctaacgggcctctgggtcatagcccacgagtgcggccaccacgccttcagcgactac

SEQ ID NO: 26712 - DNA, 309 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaaccgacaacacccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaaccggcgtctgggtcatagcccacgagtgcggccaccacgcctgcagcgactac

SEQ ID NO: 26713 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26714 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26715 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccacctcactgcttcaaacgctcgatccctcgctctttctcctacctcatctgggacatcatcatagcctcctgcttctactacgtcgccaccacttacttcactctcctccctcaccctctctcctacttcgcctggcctctctactgggcctgccaagggtgcgtcctaaccggcgtctgggtcatagcccacgagtgcggccaccacgccttcagcgactac

SEQ ID NO: 26716 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccagacctcaagaaagcaatcccacctcactgcttcaaacgctccatccctcgctccttctcctacctcatctgggacatcatcatagcctcctgcttctactacgtcgccaccacttacttccctctcctccctcaccctctctccttcttcgcctggcctctctactgggcctgccatggctgcgtcctaaccggcgtctgggtcatagcccacgagtgcggccaccacgccttcagcaactac

SEQ ID NO: 26717 - DNA, 326 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26718 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacctcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 26719 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttcttccaccgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagcctggcctctctactgggcctgccagggctgcgtcctaaccggcgtctgggtcatagcccacgagtgcggccaccacgccttcagcgactac

SEQ ID NO: 26720 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 26721 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 26722 - DNA, 314 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcacttcactgtagaactcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 26723 - DNA, 352 bp, Artificial
  Mutation in BnaA.FAD2.a introduced by TALE nuclease pair BnFAD2_T03
caggatccatgggtgcaggtggaagaatgcaagtgtatactcactccaaaaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 26724 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26725 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactgc

SEQ ID NO: 26726 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaactcaagaaagcaatcccaccgcactgtttcaaacgctcgatccctcgctctttctcctacctcatctgggacatcatcatagcctcctgcttctactacgtcgccaccacttacttccctctactccctcaccctctctcctacttcgcctggcctctctactgggcctgccagggctgcgtcctaaccggcgtctgggtcatagcccacgagtgcggccaccacgccttcagcgactac

SEQ ID NO: 26727 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26728 - DNA, 347 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26729 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctacttcgcctggcctctctactgggcctgccagggctgcgtcctaaccggcgtctgggtcatagcccacgagtgcggccaccacgccttcagcgactac

SEQ ID NO: 26730 - DNA, 350 bp, Artificial
  Mutation in BnaA.FAD2.a introduced by TALE nuclease pair BnFAD2_T03
caggatccatgggtgcaggtggaagaatgcaagtctctcctccctccaaaaagcctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26731 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26732 - DNA, 359 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcgccagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26733 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccagggctgcgtcctaaccggcgtctgggtcatagcccacgagtgcggccaccacgccttcagcgactac

SEQ ID NO: 26734 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggactctctactgggcctgccagggctgcgtcctaaccggcgtctgggtcatagcccacgagtgcggccaccacgccttcagcgactac

SEQ ID NO: 26735 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcactac

SEQ ID NO: 26736 - DNA, 432 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagcggctgttgccggtgctgtgccaggcccacggcttgaccccggagcaggtggtggccatcgccagccacgatggcggtggggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgaatgcggccaccacgccttcagcgactac

SEQ ID NO: 26737 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccccccccctctcccttacctcgcctggcccctctactgggcctgccaaggctgcgtcctaacgggcctctgggtcatagcccacgagtgcggccaccacgccttcagcgactac

SEQ ID NO: 26738 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccagggctgcgtcctaaccggcgtctgggtcatagcccacgagtgcggccaccacgccttcagcgactac

SEQ ID NO: 26739 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaaccggatcaaagagttcctccgccgctggacctaccaaggcaacgctatgttctaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26740 - DNA, 349 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26741 - DNA, 350 bp, Artificial
  Mutation in BnaA.FAD2.a introduced by TALE nuclease pair BnFAD2_T03
caggatccatgggtgcaggtggcagaatgcaagtgtatcctccctccaaaaagtctaaaaccgacaacctcaagcgcgtaccctgcgagacaccgcccttcactcgagacctcaagaaagcaatcccacctcactgcttcaaacgctccatccctcgctctttctcctacctcatctgggacatcatcatagcctcctgcttctactacgtcgccaccacttacttccctcacctccctcaccctctctcctacttcgcctggcctctctactgggcctgccaagggtgcgtcctaaccggcgtctgggtcatagcccacgagtgcggccaccacgccttcagcgactac

SEQ ID NO: 26742 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26743 - DNA, 348 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcgcacgagtgcggccaccacgccttcagcgactac

SEQ ID NO: 26744 - DNA, 407 bp, Artificial
  Mutation in BnaA.FAD2.a introduced by TALE nuclease pair BnFAD2_T03
caggatccatgggtgcaggtggcagaatgcaagtctctcctccctccaaaaagtctgaaaccgacaacatcaagcgcgtaccctgcgagacaccgcccttcactgtcgtggacaccaaggcctactccggcggctacaacctgcccatcggccaggccgacgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26745 - DNA, 355 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26746 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccaatggtgcgtcctaaccggcgtctgggtcatatcccacgagtgcggccaccacgccttcagcgactac

SEQ ID NO: 26747 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccattcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26748 - DNA, 351 bp, Artificial
  Mutation in BnaA.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26749 - DNA, 349 bp, Artificial
  Mutation in BnaA.FAD2.a introduced by TALE nuclease pair BnFAD2_T03
caggatccatgggtgcaggtggaagaatgcaagtgtcacctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagtccacgagtgcggccaccacgccttcagcgactac

SEQ ID NO: 26750 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 26751 - DNA, 351 bp, Artificial
  Mutation in BnaA.FAD2.a introduced by TALE nuclease pair BnFAD2_T03
ccaggatccatgggtgcaggtggaagaatgcaagtgtctcctccatccaagaagtctgaaaccgacaccatcaagcgcgtaccctgcgagacaccgcccttcactgtagaactcaagaaagcaatcccaccgcactgtttcaaacgctcgatcccttgctctttctcctacctcatctgggacatcatcatagcctcctgcttctactacgtcgccaccacttactcccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26752 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26753 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcagggctgcgtcctaaccggcgtctgggtcatagcccacgagtgcggccaccacgccttcagcgactac

SEQ ID NO: 26754 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26755 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctggaacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26756 - DNA, 350 bp, Artificial
  Mutation in BnaA.FAD2.a introduced by TALE nuclease pair BnFAD2_T03
caggatccatgggtgcaggtggaagaatccaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 26757 - DNA, 340 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgttcggctgcggcgagcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccagggctgcgtcctaaccagcgtctgggtcatagcccacgagtgcggccaccacgccttcagcgactac

SEQ ID NO: 26758 - DNA, 385 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgtgagacaccgcccttcacgaggcttgttgtgaagggattccaacaaaaagtaggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26759 - DNA, 349 bp, Artificial
  Mutation in BnaA.FAD2.a introduced by TALE nuclease pair BnFAD2_T03
caggatccatgggtgcaggtggaacaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26760 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 26761 - DNA, 286 bp, Artificial
  Mutation in BnaA.FAD2.a introduced by TALE nuclease pair BnFAD2_T03
caggatccatgggtgcagtggaagaatgcaagtgtctcctccctccaagaagtctgaaaccgacaccatcaagcgcgtaccctgcgagacaccgcccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26762 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26763 - DNA, 341 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26764 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagactgaaaccgacaccataaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26765 - DNA, 340 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26766 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagaactcaagaaagcaatcccaccgcactgtttcaaacgctcgatccctcgctctttctcctacctcatctgggacatcatcatagcctcctgcttctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26767 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26768 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggtccctctactgggcctgccaagactgcgtcctaacgggcctctgggtcatcgcccacgaatgcggccaccacgccttcagcgactac

SEQ ID NO: 26769 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26770 - DNA, 347 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagtgactac

SEQ ID NO: 26771 - DNA, 370 bp, Artificial
  Mutation in BnaA.FAD2.a introduced by TALE nuclease pair BnFAD2_T03
caggatccatgggtgcaggtagaagaatgcaagtgtctcctccctccaaaaagtctgaaaccgacaacatcaagcgcgtaccctgcgagacaccgcccttcactgtcggagaacgctctcctgagtagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccaagagtgcgtcctaaccggcgtctgggtcatagcgcacgagtgcggccaccacgccttcagcgactac

SEQ ID NO: 26772 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26773 - DNA, 383 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaacgaccttttggaaacttcggcttcccctgaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 26774 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttcactctcctccctcaccctctctcctacttcgcctggcctctctactgggcctgccagggctgcgtcctaaccggcgtctgggtcatagcccacgagtgcggccaccacgccttcagcgactac

SEQ ID NO: 26775 - DNA, 304 bp, Artificial
  Mutation in BnaA.FAD2.a introduced by TALE nuclease pair BnFAD2_T03
caggatccatgggtgcaggtggaagaatgcaagtgtctccaccctccaaaaagtctgaaaccgacaacatcaagcaatcccaccgcactgtttcaaacgcttgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26776 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 26777 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacctcaagcgcgtaccctgcgagacaccgcccttcactgtcggtgaacgctctcctgagtagaactcaagaaagcaatcccaccgcactttttcaaacgctcgatccctcgctctttctcctacctcatctgggacatcatcatagcctcctgcttctactacgtcgccaccacttacttccctccccgccctcaccctctcgcctactgcgcctggcctctctactgggcctgccaagggtgcgtcctaaccggcgtcggggtcatagcccacgagtgcggccaccacgccttcagcgactac

SEQ ID NO: 26778 - DNA, 331 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgggagaactcaagaaagcaatagaaccgcactgtgccaaacgcccgatccctcgctctttctcctacctcatctgggacatcatcatagcctcctgcttctactacgtcgccaccacttacttccctctcccccctcaccctctctcctgcttcgcctggcctctctactgggcctgccagggctgcgtcctaaccggcctctgggtcatagcccacgagtgcggccaccacgccttcagcgactac

SEQ ID NO: 26779 - DNA, 318 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 26780 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26781 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26782 - DNA, 333 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 26783 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26784 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctggcctctctactgggcctgccagggctgcgtcctaaccggcgtctgggtcatagcccacgagtgcggccaccacgccttcagcgactac

SEQ ID NO: 26785 - DNA, 309 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaaccgacaacacccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26786 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccactagtgcggccaccacgccttcagcgactac

SEQ ID NO: 26787 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26788 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26789 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26790 - DNA, 304 bp, Artificial
  Mutation in BnaA.FAD2.a introduced by TALE nuclease pair BnFAD2_T03
caggatccattggtgcaggtggaagaatgcaagtgtctcctccctccaaaaagtctgaaaccgacaacatcaagcaatcccaccgcactgtttcaaacgcttgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26791 - DNA, 344 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26792 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26793 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtccttaccggcgtctgggtcatagcccacgagtgcggccaccacgccttcagcgactac

SEQ ID NO: 26794 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaagaactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 26795 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 26796 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaaccttcggattgatcttttcctgctccccggctatgagccacgccatggcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26797 - DNA, 349 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26798 - DNA, 343 bp, Artificial
  Mutation in BnaA.FAD2.a introduced by TALE nuclease pair BnFAD2_T03
catgatccatgggtgcaggtggaagaatgcaagtgtctcctccctccaaaaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 26799 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 26800 - DNA, 348 bp, Artificial
  Mutation in BnaA.FAD2.a introduced by TALE nuclease pair BnFAD2_T03
gcaggatccatgggtgcaggtggaagaatgcaagtgtatcctccctccaaaaagtctgaaaccgacaacatcaagcgcgtaccctgcgagacaccgcccttcaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26801 - DNA, 380 bp, Artificial
  Mutation in BnaA.FAD2.a introduced by TALE nuclease pair BnFAD2_T03
caggatccatgggtgcaggtggaagaatgcaagtgtctcctccctccaaaaagtccgaaaccgacaacatcaagcgcgtaccctgcgagacaccgcccttcactgtcgatggccaccacctgctccggggtcaagccgaactcaagaaagcattcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26802 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactctagaactcaagagagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtactaaccggcgtctgggtcatagcccacgagtgcggccaccacgccttcagcgactac

SEQ ID NO: 26803 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26804 - DNA, 349 bp, Artificial
  Mutation in BnaA.FAD2.a introduced by TALE nuclease pair BnFAD2_T03
caggatccatgggtgaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26805 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26806 - DNA, 331 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 26807 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagctactac

SEQ ID NO: 26808 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 26809 - DNA, 287 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26810 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccgccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26811 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26812 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccattaagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26813 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 26814 - DNA, 335 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26815 - DNA, 348 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26816 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacctcaagcgcgtaccctgcgagacaccgcccttcacttcttccaccgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26817 - DNA, 314 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26818 - DNA, 419 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtccgactgagcctttcgttttatttgttgtttgtcggtgaacgctctcctgagtaggacaaatccgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26819 - DNA, 348 bp, Artificial
  Mutation in BnaA.FAD2.a introduced by TALE nuclease pair BnFAD2_T03
caggatccatgggtgcagggggaagaatgcaagtctctcctccctccagctcccccgaaaccaaaaccctcaaacgcgtcccctgcgagacaccacccttcactcgacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26820 - DNA, 330 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcgccaccacgccttcagcgactac

SEQ ID NO: 26821 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctctccctctctcctacttcgcctggcctctctactgggcctgccaaggctgcgtcctaacgggcctctgggtcatcgcccacgaatgcggccaccacgccttcagcgactac

SEQ ID NO: 26822 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacttagaactcaagaaagcaatcccacctcactgtttcaaacgctcgatccctcgctctttctcctacctcatctgggacatcatcatagcctcctgcttctactacgtcgccaccgcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26823 - DNA, 436 bp, Artificial
  Mutation in BnaA.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgtaccccggagcaggtggtggccatcgccagcaatattggtggcaagcaggcgctggagacggtgcaggtggtggggtcaagccgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26824 - DNA, 401 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaaagctggtttgcatgcaggcctctgcagtcgacgggcccgggatccgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 26825 - DNA, 350 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaactcaagaaagcaatcccaccgcactgtttcaaacgctcgatcccccgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26826 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctcttcgacatcatcatctcctcctcggctcctccctctaccacctctccacagcctacttccctctcctcccccaccctctcccttacctcgcctggcccctctactcggcctgccagggctgcgtcctaaccggcgtctgggtcatagcccacgagtgcggccaccccgccttcagcgactac

SEQ ID NO: 26827 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatggcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26828 - DNA, 402 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26829 - DNA, 350 bp, Artificial
  Mutation in BnaA.FAD2.a introduced by TALE nuclease pair BnFAD2_T03
caggatccatgggtgcaggtggaagaatgcaagtgtcgcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctccccctctctccgactccgcctcgcctctctactgggcctgccagggctgcgtcctaaccggcgtcggggtcatagcccgcaagtgcggccaccacgccttcagcgactgc

SEQ ID NO: 26830 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaatggtgcgtcctaaccggcgtctgggtcatagcccacgagtgcggccaccacgccttcagcgactac

SEQ ID NO: 26831 - DNA, 329 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgaccac

SEQ ID NO: 26832 - DNA, 351 bp, Artificial
  Mutation in BnaA.FAD2.a introduced by TALE nuclease pair BnFAD2_T03
caggatccatgggtgcaggtggcagaatgcaagtgtctactccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcgcacgagtgcggccaccacgcctgcagcgactac

SEQ ID NO: 26833 - DNA, 347 bp, Artificial
  Mutation in BnaA.FAD2.a introduced by TALE nuclease pair BnFAD2_T03
caggatccaatgggtgcaggtggaagaatgtaagtctctcctccctccagctcccccgaaaccaaaaccctcaaacgcgtcccctgcgagacaccacccttaaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26834 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctatctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26835 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagtgctgcgtcctaaccggcgtctgggtcatagcccacgagtgcggccaccacgccttcagcgactac

SEQ ID NO: 26836 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaactgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26837 - DNA, 354 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26838 - DNA, 435 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcatcctcacctcctccagggtcagggtgccggcctttggtggcaagcaggcgctggagacggtccagcggctgttgccggtgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26839 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttggcgatggccaccacctgctggggggtcaagccgtgggcctggcacagcaccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 26840 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26841 - DNA, 351 bp, Artificial
  Mutation in BnaA.FAD2.a introduced by TALE nuclease pair BnFAD2_T03
caggatccatgggtgcaggtggaagaatgcaagtgtctcctaactccaaaaagcctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttcactctcctccctcaccctctctcctacttcgcctggcctctctactggtcctgccagggctgcgtcctagccggcgtctgggtcatagcccacgagtgcggccacgacgccttcagcgactac

SEQ ID NO: 26842 - DNA, 408 bp, Artificial
  Mutation in BnaA.FAD2.a introduced by TALE nuclease pair BnFAD2_T03
caggatccatgggtgctggtggaagaatgcaagtgtctcctccctccaaaaagtctgaaaccgacaacatcaagcgcgtaccctgcgagacaccgcccttcactgtcggggtcaagccgtgggcctggcacagcaccggcaacagccgctggaccgtctccaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26843 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 26844 - DNA, 393 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26845 - DNA, 355 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26846 - DNA, 384 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagactgagcctttcgttttatctgttgtttgtcggtgaacgctctcctgagtaggtcaaatccgctctgtttcaaacgctcgatccctcgctctttctcctacctcatctgggacatcatcatagcctcctgcttctactacgtcgccaccacttacgtccctctcctccctcaccctctctcctgcttcgcctggcctctctactgggcctgccagggctgcgacctaaccggcgtctgggtcatagcccacgagtgcggccaccacgccttcagcgaccac

SEQ ID NO: 26847 - DNA, 325 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgagcctgccagggctgcgtcctaaccggcgtctgggtcatagcgcacgagtgcggccaccacgccttcagcgactac

SEQ ID NO: 26848 - DNA, 350 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26849 - DNA, 332 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26850 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgatacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26851 - DNA, 324 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26852 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctccctctaccacctctccacagcctacttccctctcctccccaccctctcccttacctcgcctggcccctctactgggcctgccaaggctgcgtcctaacgggcctctgggtcatcgcccacgaatgcggccaccacgccttcagcgactac

SEQ ID NO: 26853 - DNA, 389 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttttgtttgccggatcaagagctaccaactctttttccgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26854 - DNA, 344 bp, Artificial
  Mutation in BnaA.FAD2.a introduced by TALE nuclease pair BnFAD2_T03
caggatccatgggtgcaggtggaagaatgcaagtctctcctcccttcagctcccccggaaccgacaccatcaagcgcgtaccctgcgagacaccgcccttcactctcaagaaagcaatccaaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26855 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaaacccaccgcactgtttcaaacgctcgatcccgcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26856 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctacgtcctaacgggcctctgggtcatagcccacgagtgcggccaccacgccttcagcgactac

SEQ ID NO: 26857 - DNA, 308 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggtctctctactgggcctgccagggctgcgtcctaaccggcgtctgggtcatagcccacgagtgcggccaccacgccttcagcgactac

SEQ ID NO: 26858 - DNA, 353 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacataagcgcgtaccctgcgagacaccgcccttcactgtcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26859 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagcactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacgtcgccgggcctctctactgggcctgccaaggctgcgtcctaacgggcctctgggtcagagcccacgagtgcggccaccacgccttcagcgactac

SEQ ID NO: 26860 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttccccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagtccacgagtgcggccaccacgccttcagcgactac

SEQ ID NO: 26861 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 26862 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26863 - DNA, 331 bp, Artificial
  Mutation in BnaA.FAD2.a introduced by TALE nuclease pair BnFAD2_T03
caggatccatgggtgcaggtggaagaatgcaagtctctcctccctccagctccccagaaaccaaaaccctcaaacgcgtcccctctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26864 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26865 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcacactctctcctacttcgcctggcctctctactgggcctgccaaggctgcgtcctaacgggcctctgggtcatcgcccacgaatgcggccaccacgccttcagcgactac

SEQ ID NO: 26866 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26867 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaagcctgcgtcctaacgggcctctgggtcatagcccacgagttcggccaccacgccttcagcgactac

SEQ ID NO: 26868 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26869 - DNA, 346 bp, Artificial
  Mutation in BnaA.FAD2.a introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26870 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26871 - DNA, 407 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtggacaccaagacctactccggcggctacaacctgcccatcggccaggccgacgaagaactcaagaaagcaatcccaccgcactgtttccaacgctcgatccctcgctctttctcctacctcatctgggacatcatcatagcctcctgcttctactacgtcgccaccacttacttccctctcctccctcaccctctctcctacttcgcctggcctctctactcggcctgccagggctgcgtcctaaccggcgtctgggtcatagcccacgagtgcggccaccacgccttcagcgactac

SEQ ID NO: 26872 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgggagaactcaagaaagcaatcccacctcactgtttcaaacgctcgatccctcgctctttctcctacctcatctgggacatcatcatagcctcctgcttctactacgtcgccaccgcttacttccctctcctcccccaccctctcccctacctcgcctggcctctctactgggcctgccagggctgcgtcctaacgggcctctgggtcatagcccacgagtgcggccaccacgccttcagcgactac

SEQ ID NO: 26873 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26874 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 26875 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgagcctgccagggctgcgtcctaaccggcgtctgggtcatagcccacgagtgcggccaccacgccttcagcgactac

SEQ ID NO: 26876 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 26877 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcatctgggtcatagcccacgagtgcggccaccacgccttcagcgactac

SEQ ID NO: 26878 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactggaactcaagatagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26879 - DNA, 411 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcaccctgaccctggaggagttgactgatagtgacctgttcgttgcaacaaattgataagcacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26880 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 26881 - DNA, 381 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgaggcatttctgtcctggctggtctagaggagaactcaagaaagcaatcccaccgcactgtttcaaacgctcgatccctcgctctttctcctacctcatctgggacatcatcatagcctcctgcttctactacgtcgccaccacttgcttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26882 - DNA, 392 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtaatccggaacatcgtatgggtaatcgatgaccttacgtttaaactcaagaaagcaatcccaccgcactgtttcaaacgcccgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26883 - DNA, 319 bp, Artificial
  Mutation in BnaA.FAD2.a introduced by TALE nuclease pair BnFAD2_T03
caggatccatgggtgcaggtggaagaatgcaagtgtctcctccctcaaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcttggtcatagcccacgagtgcggccaccacgccttcagcgactac

SEQ ID NO: 26884 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcgaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26885 - DNA, 354 bp, Artificial
  Mutation in BnaA.FAD2.a introduced by TALE nuclease pair BnFAD2_T03
caggatccatgggtgcaggtggaagaatgcaagtctctcctccatccagctcccccggaaccaacaccctcaaacgcgtcccctgcgagacaccaccattcactctcgggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26886 - DNA, 443 bp, Artificial
  Mutation in BnaA.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgtcggtcataatgtttttggtacaaccgatttagctttatgctctgaggcttagaccgagatagggttgagtgttgttccagtttggaacaagagtccactatttaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26887 - DNA, 283 bp, Artificial
  Mutation in BnaA.FAD2.a introduced by TALE nuclease pair BnFAD2_T03
caggatccatgggtgcaggtggaagaatgcaagtgtctcctcccttaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26888 - DNA, 347 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26889 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26890 - DNA, 349 bp, Artificial
  Mutation in BnaA.FAD2.a introduced by TALE nuclease pair BnFAD2_T03
caggatccatgggtgcaggtgccagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccttctcctccctcaccctctctcctacttcgcctggcctctctactgggcctgccagggctgcgtcctaaccggcgtctgggtcatagcccacgagtgcggccaccacgccttcagcgactac

SEQ ID NO: 26891 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26892 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26893 - DNA, 345 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26894 - DNA, 452 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtggccatcgccagcaataatggtggcaggtggtggccatcgccagcaatggcggtggcaagcaggcgctggagacggtccagcggctgttgccggtgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaaccggcgtctgggtcatagcccacgagtgcggccaccacgccttcagcgactac

SEQ ID NO: 26895 - DNA, 341 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 26896 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26897 - DNA, 295 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26898 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatcgcccacgaatgcggccaccacgccttcagcgactac

SEQ ID NO: 26899 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtctggcctctctactgggcctgccaagggtgcgtcctaaccggcgtctgggtcatagcccacgagtgcggccaccacgccttcagcgactac

SEQ ID NO: 26900 - DNA, 371 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcgggtgtgggggttacgtagacctcaagaaagcaatcccaccgcactgtttcaaacgctcgatccctcgctctttctcctacctcatctgggacatcatcatagcctcctgcttctactacgtcgccaccacttacttccatctcctccctcaccctctctcctacttcgcctggcctctctactgggcctgccagggctgcgtcctaaccggcgtctgggtcatagcccacgagtgcggccaccacgccttcagcgactac

SEQ ID NO: 26901 - DNA, 351 bp, Artificial
  Mutation in BnaA.FAD2.a introduced by TALE nuclease pair BnFAD2_T03
caggatccatgggtgcaggtggaagaatgcaagtgtctcctccctacaagaagtctgaaaccgacaccatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26902 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 26903 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctactacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26904 - DNA, 348 bp, Artificial
  Mutation in BnaA.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcactgtaactcaagatagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26905 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26906 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccatcagcgactac

SEQ ID NO: 26907 - DNA, 441 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacagcaccggcaacagccgctggaccgtctccagcgcctgcttgccaccgccaagccgtgggcctggcacagcaccggcaacagccgctggacgacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26908 - DNA, 349 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26909 - DNA, 308 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26910 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26911 - DNA, 354 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26912 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 26913 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26914 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 26915 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26916 - DNA, 345 bp, Artificial
  Mutation in BnaA.FAD2.a introduced by TALE nuclease pair BnFAD2_T03
cgggatccatgggtgcaggtggaagcatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcgcctggcctctctacggggcctgccagggctgcgtcctaaccggcgtctgggtcatagcccacgagtgcggccaccacgccttcagcgactac

SEQ ID NO: 26917 - DNA, 382 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccctcaagcgcgtcccctgcgagacaccgcccttcactgtacagccgctggaccgtctccagcccctgtcggagaactcaagaaagcaatcccaccgcactgtttcaaacgctcgatccctcgctctctctcctacctcatctgggacatcctcatcgcctcctgcttctactacgtcgccaccgcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26918 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaggtacctcgcgaatgcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26919 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactcggcctgccagggctgcgtcctaaccggcgtctgggtcatagcccacgagtgcggccaccacgccttcagcgactac

SEQ ID NO: 26920 - DNA, 410 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtcggcctggcacagcaccggcaacagccgctggaccgtctccagcgcctgcttgccaccattagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactacgcctggcctctctactgggcctgccagggctgcgtcctaaccggcgtctggtcatggcccacgagtgcggccaccacgccttcagcgactac

SEQ ID NO: 26921 - DNA, 377 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtggggttccgatttagtgctttacggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26922 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcctcttcgacatcctcgtctcctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 26923 - DNA, 350 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26924 - DNA, 341 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26925 - DNA, 349 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacatcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26926 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgcccgatccctcgctctttctcctacctcatctgggacatcatcatagcctcctgcttctactacgtcgccaccacttacttccctctcctcccccaccctctcccttacctcgcctggcctctctactgggcctgccagggctgcgtcctaaccggcctctgggtcatcgcccacgaatgcggccaccacgccttcagcgactac

SEQ ID NO: 26927 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26928 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 26929 - DNA, 373 bp, Artificial
  Mutation in BnaA.FAD2.a introduced by TALE nuclease pair BnFAD2_T03
caggatccatgggtgcaggtcgaagaatgcaagtgtctcctccctccaaaaagtctgaaaccgacaacatcaagcgcgtaccctgcgagacaccgcccttcacattaaccagctgcattaatgaatcggccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26930 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatatcccacgagtgcggccaccacgccttcagcgactac

SEQ ID NO: 26931 - DNA, 337 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26932 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26933 - DNA, 305 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgtgtcatagcccacgagtgcggccaccacgccttcagcgactac

SEQ ID NO: 26934 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26935 - DNA, 349 bp, Artificial
  Mutation in BnaA.FAD2.a introduced by TALE nuclease pair BnFAD2_T03
caggatccatgggtgcaggtggaagaatgcaagtatctcctccctccaaaaagtctgaaaccgacaacatcaagagcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26936 - DNA, 383 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaacgaccttttggaaacttcggcttcccctgaaagaactcaagaaagcaatcccaccgcactgtttcaaccgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26937 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26938 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtgaacgctctcctgagtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgccttcagcgactac

SEQ ID NO: 26939 - DNA, 350 bp, Artificial
  Mutation in BnaA.FAD2.a introduced by TALE nuclease pair BnFAD2_T03
caggatccatgggtgcaggtggaagaatacaagtgcatcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26940 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccgatctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccttccagggctgcgtcctaaccggcgtctgggtcatagcccacgagtgcggccaccacgccttcagcgactac

SEQ ID NO: 26941 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcctggcctctctactgggcctgccagggctgcgtcctaaccggcgtctgggtcatagcccacgagtgcggccaccacgccttcagcgactac

SEQ ID NO: 26942 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactgagaactcaagaaagcaatcccaccgcattgtttcaaacgctcgatccctcgctctttctcctacctcatctgggacatcatcatagcctccttcttctactacgtcgccaccacttacttccctctcctccctcaccctctctccttcttcccccggcctctctactgggcctgccagggctgcgtcctaaccggcgtctgggtcatagcccacgagtgcggccaccacgccttccgcgactac

SEQ ID NO: 26943 - DNA, 280 bp, Artificial
  Mutation in BnaA.FAD2.a introduced by TALE nuclease pair BnFAD2_T03
caggatccatgggtgcaggtggaagaatgcaagtctcgacctcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatagcccacgagtgcggccaccacgccttcagcgactac

SEQ ID NO: 26944 - DNA, 336 bp, Artificial
  Mutation in BnaA.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26945 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacattaagcgcgtaccctgcgagacaccgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26946 - DNA, 348 bp, Artificial
  Mutation in BnaA.FAD2.a introduced by TALE nuclease pair BnFAD2_T03
caggtccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26947 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcgccctctctcctacttcgcctggcctctctactgggcctgccagggctgcgtcctaaccggcgtctgggtcatagcccacgagtgcggccaccacgccttcagcgactac

SEQ ID NO: 26948 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26949 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26950 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26951 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctggcccctctactgggcctgccaaggctgcgtcctaacgggcctctgggtcatcgcccacgaatgcggccaccacgccttcagcgactac

SEQ ID NO: 26952 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatcgcccacgaatgcggccaccacgccttcagcgactac

SEQ ID NO: 26953 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26954 - DNA, 329 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26955 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcccccgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26956 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 26957 - DNA, 456 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggctgttgccggtgctgtgccaggcccacggcttgaccccggagcaggtggtggccatcgccagcaatattggtggcaagcaggcgctggagacggtgcaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26958 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctcccacaccctctctcctacttcgcctggcctctctactgggcctgccaagggtgcgtcctaaccggcgtctgggtcatagcccacgagtgcggccaccacgccttcagcgactac

SEQ ID NO: 26959 - DNA, 398 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgggcgactgccctgctgcgtaacatcgttgctgctccataacatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26960 - DNA, 381 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttcgaggcatttctgtcctggctggtctagaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26961 - DNA, 349 bp, Artificial
  Mutation in BnaA.FAD2.a introduced by TALE nuclease pair BnFAD2_T03
caggatccatgggtgcaggtgcaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26962 - DNA, 411 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgtacgtgccccacgagtacatcgagctgatcgagatcgcccggaacagcacccaggaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26963 - DNA, 351 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaagggtgcgtcctaacgggcctctgggtcatagcccacgagtgcggccaccacgccttcagcgactac

SEQ ID NO: 26964 - DNA, 323 bp, Artificial
  Mutation in BnaA.FAD2.a introduced by TALE nuclease pair BnFAD2_T03
caggatccatgtgtgcaggtggaagaatgcaagtgtctcctccctccaagaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 26965 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacttcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 26966 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatatcccacgagtgcggccaccacgccttcagcgactac

SEQ ID NO: 26967 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttcgcctggcctctctactgggcctgccaaggctgcgtcctaacgggcctctgggtcatagcccacgagtgcggccaccacgccttcagcgactac

SEQ ID NO: 26968 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcagggctgcgtcctaaccggcgtctgggtcatagcccacgagtgcggccaccacgccttcagcgactac

SEQ ID NO: 26969 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcacgactac

SEQ ID NO: 26970 - DNA, 327 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26971 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctacttggcctgccaaggctgcgtcctaacgggcctctgggtcatagcccacgagtgcggccaccacgccttcagcgactac

SEQ ID NO: 26972 - DNA, 349 bp, Artificial
  Mutation in BnaA.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 26973 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26974 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccagggctgcgtcctaaccggcgtctgggtcatagcccacgagtgcggccaccacgcctccagcgactcc

SEQ ID NO: 26975 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26976 - DNA, 356 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26977 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26978 - DNA, 317 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26979 - DNA, 351 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctactgcgcctggcctctctactgggcctgccagggctgcgtcctaaccggcgtctgggtcatagcccacgagtgcgcccaccacgccttcagcgactac

SEQ ID NO: 26980 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 26981 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggccactctactgggcctgccagggctgcgtcctaaccggggaatgggtaatagcccacgagtgcggccaccacgccttcagcgactac

SEQ ID NO: 26982 - DNA, 319 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26983 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccagggctgcgtcctaaccggcgtctgggtcatagcccacgagtgcggccaccacgccttcagcgactac

SEQ ID NO: 26984 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgagacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26985 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaacctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccgcgagtgcggccaccacgccttcagcgactac

SEQ ID NO: 26986 - DNA, 389 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggtttgtttgccggatcaagagctaccaactctttttccgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatatcccacgagtgcggccaccacgccttcagcgactac

SEQ ID NO: 26987 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccgcttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26988 - DNA, 430 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtaccctgcgaaacaccgcccttccatttggtacaccgccctacaccgcccttcacacgcccgccataaactgccaggcatcaaactaagcagaaggccatcctgacggagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26989 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcaatccctcgctctttctcctacctcatctgggacatcatcatagcctcatgcttctactacgtcgccaccacttacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 26990 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26991 - DNA, 397 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagcaggtggtggccatcgccagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26992 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatggcccacgagtgcggccaccacgccttcagcgactac

SEQ ID NO: 26993 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26994 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccctgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 26995 - DNA, 408 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcgtcgttccactgagcgtaagaactccggggtcaagccgtgggcctggcacagcaccggagaactcaagaaagcaatcccaccgcactgtttcaaacgctcgatccctcgctctttctcctacctcatctgggacatcatcatagcctgctgcttctactacgtcgccaccacttacttccctctccgccctcgcccgctcgcctacgtcgcctggcctctctactgggcctgccgggggtgcgtcctaaccgggggctgggtgatagcccacgagtgcggccaccacgcctgcagcgactac

SEQ ID NO: 26996 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 26997 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 26998 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 26999 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27000 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcctctctactgggcctgccagggctgcgtcctaaccggcgtctgggtcatagcccacgagtgcggccaccacgccttcagcgactac

SEQ ID NO: 27001 - DNA, 354 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27002 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27003 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaagaccccaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27004 - DNA, 331 bp, Artificial
  Mutation in BnaA.FAD2.a introduced by TALE nuclease pair BnFAD2_T03
caggatccatgggtgcaggtggaagaatgcaagtgcctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 27005 - DNA, 423 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcgatggccaccacctgctccggggtcaagccgtgggcctggcacagcacctgcaacaggcgctggagactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27006 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcaagcaatcccaccgcactgtttcaaacgatcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27007 - DNA, 435 bp, Artificial
  Mutation in BnaA.FAD2.a introduced by TALE nuclease pair BnFAD2_T03
caggatccatgggtgcaggtggaagaatgcaagtgactcctccctccaaaaagcctgaaaccgacaacatcaagcgcgtaccctgcgagacaccgcccttcactgtcatcctcacctcctccagggtcagggtgccggcctttggtggcaagcaggcgctggagacggtccagcggctgttgccggtgcggagaactcaagaaagcaatcccaccgcactgtttcaaacgctcgatccctcgctctttctcctacctcatctgggacatcatcatagcctcctgcttctactacgtcgccaccacttacgtccctctcctcccgcaccctctctcctacttcgcctggcctctctactgggcctgccagggctgcgtcctaaccggcgtctgggtcatagcccacgagtgctgccaccacgccttcagcgactac

SEQ ID NO: 27008 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagtctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 27009 - DNA, 319 bp, Artificial
  Mutation in BnaA.FAD2.a introduced by TALE nuclease pair BnFAD2_T03
caggatccatgggtgcaggtggaagaatgcaagtgtctcctccctccagctcccccggaaccaacaccctcaaatgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27010 - DNA, 385 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcctgcttgccaccgccattgctggcgatggccaccacctttgacctcaagaaagcaatcccacctcactgcttcaaacgctccatcccacgctccttctcctcttcgacatcatcatagcctcctgcttctactacgtcgccaccacttacttccctctccgccctcaccctctctcctgcttcgcctggcctctctactgggcctgccagggctgcgtcctaaccggcgtctgggtcatagcccacgagtgcggccaccacgccatcagcgactac

SEQ ID NO: 27011 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcagggctgcgtcctaaccggcgtctgggtcatagcccacgagtgcggccaccacgccttcagcgactac

SEQ ID NO: 27012 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgctgccaccacgccttcagcgactac

SEQ ID NO: 27013 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgattgtagaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 27014 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 27015 - DNA, 347 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaccctcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27016 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgtgcctgccagggctgcgtcctaaccgtcgtctgggtcatagcccacgagtgcggccaccacgccttcagcgactac

SEQ ID NO: 27017 - DNA, 341 bp, Artificial
  Mutation in BnaA.FAD2.a introduced by TALE nuclease pair BnFAD2_T03
caggatccatgggtgcaggtgaaagaatgcaagtgtctcctccctccaagaagtctgaaaccgacaccatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccgcgagtgcggccaccacgccttcagcgactac

SEQ ID NO: 27018 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 27019 - DNA, 348 bp, Artificial
  Mutation in BnaA.FAD2.a introduced by TALE nuclease pair BnFAD2_T03
caggatccatgggtgcaggtggaagaatgcaagtgtgtcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27020 - DNA, 287 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27021 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27022 - DNA, 326 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagtccacgagtgcggccaccacgccttcagcgactac

SEQ ID NO: 27023 - DNA, 350 bp, Artificial
  Mutation in BnaA.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27024 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27025 - DNA, 317 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccatgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27026 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 27027 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccaccgcactgttccaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27028 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctggcctctctactgggcctgccagggctgcgtcctaaccggcgtctgggtcatagcccacgagtgcggccaccacgccttcagcgactac

SEQ ID NO: 27029 - DNA, 334 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27030 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgagtgcggccaccacgccttcagcgactac

SEQ ID NO: 27031 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcataccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 27032 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgggcctgccagggctgcgtcctaaccggcgtctgggtcatagcccacgagtgcggccaccacgccttcagcgactac

SEQ ID NO: 27033 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27034 - DNA, 410 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgactcaagacgatagttaccggataaggcgcagcggtcgggctgaacggggggtcgaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 27035 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccttctcctccctcaccctctctcctacttcgcctggcctctctactgggcctgccagggctgcgtcctaaccggcgtctgggtcatagcccacgagtgcggccaccacgccttcagcgactac

SEQ ID NO: 27036 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27037 - DNA, 341 bp, Artificial
  Mutation in BnaA.FAD2.a introduced by TALE nuclease pair BnFAD2_T03
caggatccatggggcaggtggaagaatgcaagtgtctcctccctccaggaagtctgaaaccgacaacatcaagcgcgtaccctgcgagacaccgcccttcactgtagaaagcaatcccaccgcactgtttcaaacgctcgatccctcgctctttctcctacctcatccgggacatcatcatagcctcctgcttctactacgtcgccaccacttacttccctctcctccatcaccctctctcctacttcgcctggcctctctactgggcctgccagggctgcgtcctaaccggcgtctgggtcatagcccacgagtgcggccaccacgccttcagcgactac

SEQ ID NO: 27038 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 27039 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgctgccaccacgccttcagcgactac

SEQ ID NO: 27040 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 27041 - DNA, 324 bp, Artificial
  Mutation in BnaA.FAD2.a introduced by TALE nuclease pair BnFAD2_T03
caggatccatgggtgcaggtggaagaatgcaagtgtctccttcctccaaaaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgagcctgccagggctgcgtcctaaccggcgtctgggtcatagcccgcgagtgcggccaccacgccttcagcgactac

SEQ ID NO: 27042 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgcttcaaacgcccgatccctcactctttctcctacctcatctggcacctcatcatagcctcctgcttctactacgtcgccaccacctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27043 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaagggtgcgtcctaaccggcgtctgggtcatagcccacgagtgcggccaccacgccatcagcgactac

SEQ ID NO: 27044 - DNA, 351 bp, Artificial
  Mutation in BnaA.FAD2.a introduced by TALE nuclease pair BnFAD2_T03
caggatccatgggcgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27045 - DNA, 373 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacattaaccagctgcattaatgaatcggccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 27046 - DNA, 349 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 27047 - DNA, 471 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtatccagcgcctgcttgccaccgccattgctggcgatggccaccacctgctggggggtcaagccgtgggcctggcacagcaccggcaacagccgctggaccgtctccagcgcctgcttgccgagaactcaagaaagcaatcccaccgcactgtttcaaacgctcgatccctcgctctgtctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27048 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcacgtacccccagcaggtggtgaccatcgccagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 27049 - DNA, 309 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaaccgacaacacccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 27050 - DNA, 341 bp, Artificial
  Mutation in BnaA.FAD2.a introduced by TALE nuclease pair BnFAD2_T03
caggatccatgggtgcaggtggaagaatgcaagtgagacctccctccaaaaagactgaaaccgacaacatcaagcgcgtaccctgcgagacaccacccttcactggaactcaagaaagcaatcccaccgcactgtttcaaacgctcgatccctcgctctttctcctacctcatctgggacatcatcatctcctcctcagctcctccctctaccacctctccacagcctacttccctctcccttacctcgcctggcccctctactgggcctgccaaggctgcgccctaacgggcctctgggtcatagcccacgagtgcggccaccacgccttcagcgactac

SEQ ID NO: 27051 - DNA, 349 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaaccggcgtctgggtcatagcccacgagtgcggccaccacgccttcagcgactac

SEQ ID NO: 27052 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27053 - DNA, 316 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaatatttaccttccctccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27054 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcatgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27055 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggttcgtcctaaccggcgtctgggtcatagcccacgagtgcggccaccacgccttcagcgactac

SEQ ID NO: 27056 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacctccctccaagtgtctcctccctcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27057 - DNA, 380 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgatggccaccacctgctccggggtcaagccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27058 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatccctcgctctttctcctacctcatctgggacatcatcataacctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27059 - DNA, 430 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtaccctgcgaaacaccgcccttccatttggtacaccgccctacaccgcccttcacacgcccgccataaactgccaggcatcaaactaagcagaaggccatcctgacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27060 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccgccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27061 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27062 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27063 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcagcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27064 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatatcccacgagtgcggccaccacgccttcagcgactac

SEQ ID NO: 27065 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaactcaagaaagcaatcccaccgcactgtttcaaacgctccatcccacgctccttctcctcttcgacatcatcatctcctcctcggctcctccctctaccacctctccacatcctccttccctctcccttacctcgcctgacccctctactgggcctgccaaggctgcgtcctaacgggcctctgggtcatagcccacgagtgcggccaccacgccttcagcgactac

SEQ ID NO: 27066 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaaggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27067 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27068 - DNA, 349 bp, Artificial
  Mutation in BnaA.FAD2.a introduced by TALE nuclease pair BnFAD2_T03
caggatccatgagtgcagtggaagaatgaaagtgtaaccaccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27069 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 27070 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaagggtgcgtcctaaccggcgtctgggtcatagcccacgagtgcggccaccacgccttcagcgactac

SEQ ID NO: 27071 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactggaactcaagatagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27072 - DNA, 373 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctctaccacctctccacagcctacttccctctcccttacctcgcctgacccctctactgggcctgccaaggctgcgtcctaacgggcctctgggtcatcgtccacgaatgcggccaccacgccttcagcgactac

SEQ ID NO: 27073 - DNA, 349 bp, Artificial
  Mutation in BnaA.FAD2.a introduced by TALE nuclease pair BnFAD2_T03
caggatccatgggtgcaggttgaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27074 - DNA, 318 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27075 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27076 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 27077 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27078 - DNA, 351 bp, Artificial
  Mutation in BnaA.FAD2.a introduced by TALE nuclease pair BnFAD2_T03
caggatccatgggtgcaggtggaagaatgcaagtatctcctccctccaaaaagtctgaaaccgacaacatcaagagcgtaccctgcgagacaccgcccttcactcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctcgcctctctactgggcctgccaagggtgcgtcctaaccggcgtctgggtcatagcccacgagtgcggccaccacgccttcagcgactac

SEQ ID NO: 27079 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27080 - DNA, 304 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27081 - DNA, 342 bp, Artificial
  Mutation in BnaA.FAD2.a introduced by TALE nuclease pair BnFAD2_T03
caggatccatgagtgcaggtgaaagaatgcaagtgggacatccctcaaaaaaggctgaaaacgacaacatcaagcgcgtaccctgcgagaccccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27082 - DNA, 318 bp, Artificial
  Mutation in BnaA.FAD2.a introduced by TALE nuclease pair BnFAD2_T03
caggatccatgggtgcatgtggaagaatgcaagtgtctcctccctccaaaaagtctgaaaccgacaacatcaagcgcgtaccctgcgagacaccgccctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27083 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27084 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27085 - DNA, 348 bp, Artificial
  Mutation in BnaA.FAD2.a introduced by TALE nuclease pair BnFAD2_T03
caggatccatgagtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccgacgtctgggtcatagcccacgagtgcggccaccacgccttcagcgactac

SEQ ID NO: 27086 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgcctggtctctctactgggcctgctagggctgcgtcctaaccggcgtctgggtcatagcccacgagtgcggccaccacgccttcagcgactac

SEQ ID NO: 27087 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgtcaagggtgcgtcctaaccggcgtctgggtcatagcccacgagtgcggccaccacgccttcagcgactac

SEQ ID NO: 27088 - DNA, 332 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgtgacacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgacac

SEQ ID NO: 27089 - DNA, 373 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacattaaccagctgcattaatgaatcggccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27090 - DNA, 334 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctccttctcctacctcctcttcgacatcctcgtctcctcctccctctaccacctctccacagcctacttccctctcccttacctcgcctggcccctctactgggcctgccaaggctgcgtcctaaccggcgtctgggtcatagcccacgagtgcggccaccacgccttcagcgactac

SEQ ID NO: 27091 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27092 - DNA, 347 bp, Artificial
  Mutation in BnaA.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27093 - DNA, 411 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacaccacctgctccggggtcaagccgtgggcctggcacagcaccggcaacatccgctggaccgtctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27094 - DNA, 349 bp, Artificial
  Mutation in BnaA.FAD2.a introduced by TALE nuclease pair BnFAD2_T03
caggatccatgggggcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27095 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27096 - DNA, 398 bp, Artificial
  Mutation in BnaA.FAD2.a introduced by TALE nuclease pair BnFAD2_T03
caggatccatgggtgcaggtggaagaatgcaagtgactcctccctccaaaaagtctgaaaccgacaacatcaagcgcgtaccctgcgagacaccgcccttcactgtcgggcgactgccctgctgcgtaacatcgttgctgctccataacatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27097 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctcacgggcctctgggtcatcgcccacgaatgcggccaccacgccttcagcgactac

SEQ ID NO: 27098 - DNA, 471 bp, Artificial
  Mutation in BnaA.FAD2.a introduced by TALE nuclease pair BnFAD2_T03
caggatccatgggtgcaggtcgaagaatgcaagtgtctcctccctccaaaaagtctgaaaccgacaacatcaagcgcgtaccctgcgagacaccgcccttcactgtatccagcgcctgcttgccaccgccattgctggcgatggccaccacctgctggggggtcaagccgtgggcctggcacagcaccggcaacagccgctggaccgtctccagcgcctgcttgccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27099 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcgtagcccacgagtgcggccaccacgccttcagcgactac

SEQ ID NO: 27100 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgagcctgccaagagtgcgtcctaaccggcgtctgggtcatagcccacgagtgcggccaccacgccttcagcgactac

SEQ ID NO: 27101 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27102 - DNA, 383 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaacgaccttttggaaacttcggcttcccctgaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27103 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcatgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27104 - DNA, 437 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggactgggcctttcgttttatctgttgtttgtcggtgaacgctctcctgagtaggacaaatccgccgggagcggatttgaacgtggagaactcaagaaagcaatcccaccgcactgtttcaaacgctcgatccctcgctctttctcctacctcatctgggacatcatcatagcctcctgcttctactacgtcgccaccacttacttccctctccgccctcaccctctctcctacttcgcctggcctctctactgggcctgccaagggtgcgtcctaaccggcgtctgggtcatagcccacgagtgcggccaccacgccttcagcgactac

SEQ ID NO: 27105 - DNA, 341 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27106 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctcaccggcgtctgggtcatagcccacgagtgcggccaccacgccttcagcgactac

SEQ ID NO: 27107 - DNA, 349 bp, Artificial
  Mutation in BnaA.FAD2.a introduced by TALE nuclease pair BnFAD2_T03
caggatccatgggtgcaggtggaagaatgcaagtttctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27108 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcttgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27109 - DNA, 354 bp, Artificial
  Mutation in BnaA.FAD2.a introduced by TALE nuclease pair BnFAD2_T03
caggatccatgggtgcaggtagaagaatgcaagtgtctcctccctccaaaaagtctgaaaccgacaccatcaagcgcgtaccctgcgagacaccgcccttcactgtcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggacaccacgccttcagcgactac

SEQ ID NO: 27110 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatatcccacgagtgcggccaccacgccttcagcgactac

SEQ ID NO: 27111 - DNA, 419 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcccacggcttgaccccccagcaggtggtggccatcgccagcaataatggtggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 27112 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27113 - DNA, 398 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggcgactgccctgctgcgtaacatcgttgctgctccataacatcggagaactcaagaaagcaatcccaccgcactgtttcaaacgctcgatccctcgctctttctcctacctcatctgggacatcatcatagcctcctgcttctacgacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 27114 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctaatacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27115 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctcaccggcgtctgggtcatagcccacgagtgcggccaccacgccttcagcgactac

SEQ ID NO: 27116 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaagctgcgtcctaacgggcctctgggtcatagcccacgagtgcggccaccacgccttcagcgactac

SEQ ID NO: 27117 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgcctcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27118 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27119 - DNA, 338 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27120 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27121 - DNA, 397 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttggcggcaacagccgctggaccgtctccagcgcctgcttgccggtggagaactcaagaaagcaatcccaccgcactgtttcaaacgctcgatccctcgctctttctcctacctcatctgggacatcatcatagcctcctgcttctactacggcgccaccacgtacgtcccgctccgccctcaccctctctccgacttcgcctggcctctctactgggcctgccagggctgcgtcctaaccggcgtctgggtcatagcccacgagtgcggccaccacgcctgcagcgactac

SEQ ID NO: 27122 - DNA, 340 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27123 - DNA, 354 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcgcgactac

SEQ ID NO: 27124 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27125 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagaactcaagaaagcaatcccaccgcactgtttcaaacgctcgatccctcgctctttctcctacctcatctgggacatcatcatagcctcctgcttctactacatcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 27126 - DNA, 317 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27127 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccaagccttcagcgactac

SEQ ID NO: 27128 - DNA, 342 bp, Artificial
  Mutation in BnaA.FAD2.a introduced by TALE nuclease pair BnFAD2_T03
gatccatgggtgcaggtggcagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27129 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctacttcgcctggcctctctactgggcctgccaagggtgcgtcctaaccggcgtctgggtcatagcccacgagtgcggccaccacgccttcagcgactac

SEQ ID NO: 27130 - DNA, 441 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgcccagtcggcagcgacatccttcggcgcgattttgccggttactgcgctgtaccaaatgcgggacaacgtaagcactacatttcgctcatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27131 - DNA, 317 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagccaacgagtgcggccaccacgccttcagcgactac

SEQ ID NO: 27132 - DNA, 309 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaaccgacaacacccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27133 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27134 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccgtcagcgactac

SEQ ID NO: 27135 - DNA, 470 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggtgctgtgccaggcccacggcttgaccccccagcaggtggtggccatcgccagcaatggcggtggcaagcaggcgctggagcagcagccactggtaacaggattcagggcaagccttaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27136 - DNA, 407 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagtggacaccaaggcctactccggcggctacaacctgcccatcggccaggccgacgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 27137 - DNA, 347 bp, Artificial
  Mutation in BnaA.FAD2.a introduced by TALE nuclease pair BnFAD2_T03
caggatccatggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27138 - DNA, 396 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggttcctggccttttgctggccttttgctcacatgttctttccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27139 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctacttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27140 - DNA, 382 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaagcgcggcgggtgggggggttacgcgcataagtgaagggcggtgtaacaatcccaccgcactgtttcaaacgctcgatccctcgctctttctcctacctcatctgggacatcatcatagcctcctgcttctactacgtcgccaccacttacttccctctcctccctcaccctctctcctactccgcctggcctctctactgggcctgccagggctgcgtcctaaccggcgtctgggtcatagcccacgagtgcggccaccacgccttcagcgacta

SEQ ID NO: 27141 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 27142 - DNA, 455 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaccacctgctgggggtcaaggcgtgggcctggcacaagaacagcaacacccccttgaccgtctcccgcgcccgcatgccacccatcttgcttgcgattgccaccaagaactcaagaaagcaatcccaccgcactgtttcaaccgctcgatccctcgctctttctccttcctcatctgggacatcatcatagcctcctgcttctactacgtcgccaccacttacttccctctcctccctcaccctctctcctacttcgcctggcctctctactgggcctgccagggctgcgtcctaaccggcgtctgggtcatatcccacgagtgcggccaccacgccttcagcgactac

SEQ ID NO: 27143 - DNA, 359 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggatcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtaatagcccacgagtgcggccaccacgccttcagcgactac

SEQ ID NO: 27144 - DNA, 341 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27145 - DNA, 420 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttcaggagagcgttcaccgacaaacaacagataaaacgaaaggcccagtcttccgactgagccagaactcaagaaagcaatcccaccgcactgtttcaaacgctcgatccctcgctctttctcctacctcctcttcgacatcatcatctcctcctcggctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 27146 - DNA, 448 bp, Artificial
  Mutation in BnaA.FAD2.a introduced by TALE nuclease pair BnFAD2_T03
caggatccatgggtgcaggtggaagaatgcaagtgcctcctccctccaaaaagtctgaaaccgacaccatcaagcgcgtaccctgcgagacaccccagcaggtggtgaccatcgccagcaataatggtggcaagccagcggctgttgccggtgctgtgccaggcccacggcttgaccccccagcaggtggtggccatcgccagcaaaactcaagaaagcaatcccaccgcactgtttcaaacgctcgatccctcgctctttctcctacctcatctgggacatcatcatagcctcatgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27147 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgacctac

SEQ ID NO: 27148 - DNA, 385 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggtcagggtgccggccttgatcatctcgccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27149 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccactacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27150 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 27151 - DNA, 448 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccccagcaggtggtgaccatcgccagcaataatggtggcaagccagcggctgttgccggtgctgtgccaggcccacggcttgaccccccagcaggtggtggccatcgccagcaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27152 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27153 - DNA, 395 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggtggccatcgccagcaatggcggtggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27154 - DNA, 332 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27155 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgagacatcatcatagcctcctgcttctactacgtcgccaccacttacttccctctcctccctcaccctctctcctacttcgcttggcctctctactgggcctgccagggctgcgtcctaacgggcgtctgggtcatagcccacgagtgcggccaacacgccttcagcgactac

SEQ ID NO: 27156 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 27157 - DNA, 277 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27158 - DNA, 341 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27159 - DNA, 350 bp, Artificial
  Mutation in BnaA.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcatggcctctctactgggcctgccagggctgcgtcctaacgggcctctgggtcatcgcccacgaatgcggccaccacgccttcagcgactac

SEQ ID NO: 27160 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 27161 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27162 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttcttctacgtcgccaccacttacttccctctcctccctcaccctctctcctacttcgcctggcctctctactgggcctgccatggctgcgtcctaacgggcctctgggtcatagcccacgagtgcggccaccacgccttcagcgactac

SEQ ID NO: 27163 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcatggcctctctactgggcctgccagggctgcgtcctaaccggcgtctgggtcatagcccacgagtgcggccaccacgccttcagcgactac

SEQ ID NO: 27164 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcttctctactgggcctgccagggctgcgtcctaaccggcgtctgggtcatagcccacgagtgcggccaccacgccttcagcgactac

SEQ ID NO: 27165 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 27166 - DNA, 435 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcatcctcacctcctccaggggcagggtgccggcctttggtggcaagcaggcgctggagacggtccagcggctgttgccggtgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcataggccgcgagtgcggccaccacgccttcagcgactac

SEQ ID NO: 27167 - DNA, 349 bp, Artificial
  Mutation in BnaA.FAD2.a introduced by TALE nuclease pair BnFAD2_T03
caggatccatgggtgcaggtcgaagaatgcaagtgtctcctccctccaaaaagactgaaaccgacaacatcaagcgcgtaccctgcgagacaccgcccttcactgagaaatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27168 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccagggctgcgtcctaaccggcgtctgggtcatagcccacgagtgcggccaccaggccttcagcgactac

SEQ ID NO: 27169 - DNA, 338 bp, Artificial
  Mutation in BnaA.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27170 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 27171 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaactgacaacatcaagcgcgtaccctgcgagacaccgcccttcactgtaactcaggaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27172 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccgcgagtgcggccaccacgccttcagcgactac

SEQ ID NO: 27173 - DNA, 340 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27174 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27175 - DNA, 395 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggtggccatcgccagcaatggcggtggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27176 - DNA, 413 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggccatcgccagcaatggcggtggcaagcaggcgctggagacggtccagcggctggtgccggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 27177 - DNA, 346 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27178 - DNA, 411 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcctggcacagcaccggcaacagccgctggaccgtctccagcgcctgcttgccaccattagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27179 - DNA, 412 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttcaggagagcgttcaccgacaaacaacagataaaacgaaaggcccagtcttccgactgagccagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27180 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccgcgagtgcggccaccacgccttcagcgactac

SEQ ID NO: 27181 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaagaactcaagaaagcaatcccaccgcactgtttcacacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27182 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaactcaagaaagcaatcccaccgcactgtttcaaacgctcgatccctcgctctttctcctacctcatctgggacatcatcatagcctcctgcttctactacgtcgccaccacttacttccctctcctccctcaccctccctcctacttcgcctggcctctctactgggcctgccaagggtgcgtcctaaccggcgtctgggtcatagcccacgagtgcggccaccacgccttcagcgactac

SEQ ID NO: 27183 - DNA, 431 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcgcgaacgtggcgagaaaggaagggaagaaagcgaaaggagcgggcgctagggcgctggcaagtgtagtggttacgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccgcgagtgcggccaccacgccttcagcgactac

SEQ ID NO: 27184 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggtcatagcccacgagtgcggccaccacgccttcagcgactac

SEQ ID NO: 27185 - DNA, 354 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27186 - DNA, 350 bp, Artificial
  Mutation in BnaA.FAD2.a introduced by TALE nuclease pair BnFAD2_T03
caggatccatgggtgcaggtggaagaatgcaagtggctcctccctccaaaaagtctgaaaccgacaacatcaagcgcgtaccctgcgagacaccgcccttcactccagaactcaagaaagcaatccgaccgcactgtttcaaacgctcgatccctcgctgtttctcctacctcatctgggacatcatcatagcctcctgcttctactacgtcgccaccacttacttccctctcctccccccccctctcccttaccccccctggcccctccactgggcctgccaaggctgcgtcctaacgggcctctgggtcatcgcccacgaatgcggccaccacgccttcagcgactac

SEQ ID NO: 27187 - DNA, 340 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27188 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27189 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccgtcagcgactac

SEQ ID NO: 27190 - DNA, 341 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggtctctctactgggcctgccagggctgcgtcctaaccggcgtctgggtcatagcccacgagtgcggccaccacgccttcagcgactac

SEQ ID NO: 27191 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27192 - DNA, 318 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgccctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27193 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27194 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27195 - DNA, 329 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacctcaagcgcgtaccctgcgagacaccgcccttcatcccaccgaactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27196 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcccttcagcgactac

SEQ ID NO: 27197 - DNA, 348 bp, Artificial
  Mutation in BnaA.FAD2.a introduced by TALE nuclease pair BnFAD2_T03
caggatccatgggtgcaggtggaagaatgcaagtgcctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27198 - DNA, 434 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcccagcaggtggtggccatcgccagcaatggcggtggcaagcaggcgctggagacggtccagcggctgttgccggtgctgtgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27199 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27200 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgcaaagggtgcgtcctaaccggcgtctgggtcatagcccacgagtgcggccaccacgccttcagcgactac

SEQ ID NO: 27201 - DNA, 305 bp, Artificial
  Mutation in BnaA.FAD2.a introduced by TALE nuclease pair BnFAD2_T03
caggatccatgggtgcaggtggaagaatgcaagtgtctcctccccccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27202 - DNA, 389 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcacccgtcagtgcattgcgccatgcatgcactgcctccagagaactcaagaaagcaatcccacctcactgcttcaaacgctccatcccacgctccttctcctcttcgacatcatcatctcctcctcggctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 27203 - DNA, 380 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgccggtgctgtgccaggcccacggcttgaccccccagcaggtggtgggaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 27204 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactacttcgcctggcctctctactgggcctgccagggctgcgtcctaaccggcgtctgggtcatagcccacgagtgcggccaccacgccttcagcgactac

SEQ ID NO: 27205 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 27206 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 27207 - DNA, 304 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27208 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttcccctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27209 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtctggcctctctactgggcctgccaagggtgcgtcctaaccggcgtctgggtcatagcccacgagtgcggccaccacgccttcagcgactac

SEQ ID NO: 27210 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatcgcccacgaatgcggccaccacgccttcagcgactac

SEQ ID NO: 27211 - DNA, 360 bp, Artificial
  Mutation in BnaA.FAD2.a introduced by TALE nuclease pair BnFAD2_T03
caggatccatgggtgcaggtggaataatgcaagtgtctcctccctccaaaaagtctgaaaccgacaacatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacttggcctgccaagggtgcgtcctaaccggcgtctgggtcatagcccacgagtgcggccaccacgccttcagcgactac

SEQ ID NO: 27212 - DNA, 325 bp, Artificial
  Mutation in BnaA.FAD2.a introduced by TALE nuclease pair BnFAD2_T03
caggatccatgggtgcaggtggaagaatgcaagtgtatccgccctccaagaagtctgaaaccgacaacatcaagcgcgtatagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27213 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcaacgactac

SEQ ID NO: 27214 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27215 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgcaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27216 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccaccgcactgtttcaaacgctccatcactcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27217 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagccaacgagtgcggccaccacgccttcagcgactac

SEQ ID NO: 27218 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27219 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27220 - DNA, 448 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcgcctgcttgccgccatcgtggctggcgatggccaccacctgctccggggtcaagccgtgggcctggcacagcaccggcaacagccgctggacggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27221 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaaggctgaaaccgacaacatcaagcgcggaccctgcgagacaccgcccttcataagaactcaagaaagcaatcccaccgcactgtttcaaacgctcgatccctcgctctgtctcctacctcatctgggacatcatcatagcctcctgcttctactacgtcgccaccacttacttccctctcctccctcaccctctctcctacttcgcctggcctctctactgggcctgccagggctgtgtcctaaccggcgtctgggtcatagcccacgagtgcggccaccacgccttcagcgactac

SEQ ID NO: 27222 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27223 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 27224 - DNA, 408 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcgtcgttccactgagcgtcagaactccggggtcaagccgtgggcctggcacagcaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27225 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccagaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 27226 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcttggtcatagcccacgagtgcggccaccacgccttcagcgactac

SEQ ID NO: 27227 - DNA, 342 bp, Artificial
  Mutation in BnaA.FAD2.a introduced by TALE nuclease pair BnFAD2_T03
caggatccatgtgtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcgtctgggtcatagcccacgagtgcggccaccccgccttcagcgactac

SEQ ID NO: 27228 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcaagaaagcaatcccacctcactgcttcaaacgctccatcccacgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27229 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcgcctggcctctctcctgggcctgcccgggctgcgtcctaaccgccgtctgggtcatagcccacgagtgcggcccccacgccctcagcgactac

SEQ ID NO: 27230 - DNA, 350 bp, Artificial
  Mutation in BnaA.FAD2.a introduced by TALE nuclease pair BnFAD2_T03
caggatccatgggtgcaggtggaagaatgcaagtgtctcctccctccagaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccatgagtgcggccaccacgccttcagcgactac

SEQ ID NO: 27231 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcataagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccatgagtgcggccaccacgccttcagcgactac

SEQ ID NO: 27232 - DNA, 452 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtggccatcgccagcaataatggtggcaggtggtggccatcgccagcaatggcggtggcaagcaggcgctggagacggtccagcggctgttgccggtgcgagaactcaagaaagcaatcccacctcactgcttcaaacgctccatccctcgctccttctcctccctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27233 - DNA, 360 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtactaaccggcgtctgggtcatagcccacgagtgcggccaccacgccttcagcgactac

SEQ ID NO: 27234 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27235 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27236 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccagggctgcgtcctaaccggcgtctgggtcatagcccacgagtgcggccaccacgccttcagcgactac

SEQ ID NO: 27237 - DNA, 369 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggtggtttgtttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 27238 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 27239 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccacctcactgcttcaaacgctccatcccacgctccttctcctcttcgacatcatcatctcctcctcggctcctccctctaccacctctccacagcctacttccctctcccttacctcgcctggcccctctactgggcctgccagggctgcgtcctaaccggcgtctgggtcatagcccacgagtgcggccaccacgccttcagcgactac

SEQ ID NO: 27240 - DNA, 339 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgccctttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27241 - DNA, 394 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtatcgacaaataatgattttattttgactgatagtgacctgttggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27242 - DNA, 374 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactaactccagaaacccgcggctgagtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27243 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctacgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27244 - DNA, 358 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27245 - DNA, 391 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtacggtccagcggctgttgccggtgctgtgccaggcccacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccgcgagtgcggccaccacgccttcagcgactac

SEQ ID NO: 27246 - DNA, 442 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttcgccagccacgatggcggcaagcaggcgctggagacggtccagcggctgttgccggtgctgtgccaggcccacggcttgaccccccagcagagaactcaagaaagcaatcccacctcactgcttcaaacgctccatccctcgctccttctcctacctcctcgtcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27247 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27248 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacgcaacaaagcaatcccaccgcaccgtttcaaccgctcgatcccccgctcttgctcctacctcacctgggacatcatcatagcctcctgcttctactacgtcgccaccacttacttccctctcctccctcaccctctcccctacctcgcctggcctctctactgggcctgccagggctgcgtcctaaccggcgtctgggtcatagcccacgagtgcggccaccacgccttcagcgactac

SEQ ID NO: 27249 - DNA, 438 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgtgccacgctgagagccagcagcaaatgaaaaatctaaagggggtcaagccgtgggcctggcacagcaccggcaacagccgctggacaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27250 - DNA, 370 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtcggtgaacgctctcctgagtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27251 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactatgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27252 - DNA, 374 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttttgccagcgcctaatgcgccgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27253 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27254 - DNA, 308 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccatcacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27255 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 27256 - DNA, 345 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctcaccggcgtctgggtcatagcccacgagtgcggccaccacgccttcagcgactac

SEQ ID NO: 27257 - DNA, 335 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 27258 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27259 - DNA, 359 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgtctccagcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27260 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtatgggtcatagcccacgagtgtggccaccacgccttcagcgactac

SEQ ID NO: 27261 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagttcggccaccacgccttcagcgactac

SEQ ID NO: 27262 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctccttgcacagcagagaactcaagaaagcaatcccaccgcactgtttcaaacgctcgatccctcgctctttctcctacctcatctgggccatcatcatagcctcctgcttctactacgccgccgccccttacttccctctccgcccccaccctctctcctacttcgcctggcctctctactgggcctgccagggctgcgtcctaaccggcgtcggggtcatagcccacgagtgcggccaccccgccgtcagcgactac

SEQ ID NO: 27263 - DNA, 343 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccatcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgtgtcctaaccggcgtctgggtcatagcccacgagtgcggccaccacgccttcagcgactac

SEQ ID NO: 27264 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctctctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27265 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 27266 - DNA, 389 bp, Artificial
  Mutation in BnaA.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgatttcttgtcaaaaatgctccactgacgttccataaattcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27267 - DNA, 347 bp, Artificial
  Mutation in BnaA.FAD2.a introduced by TALE nuclease pair BnFAD2_T03
catgatccatgggtgcaggtggaagaatgcaagtgtctcctccctccaaaaagtctgaaaccgacaccatcaagcgcgtaccctgcgagacaccgcccttcactgtactcaagaaagcaatcccaccgcactgtttcaaacgctcgatccctcgctctttctcctacctcatctgtgacatcatcatagcctcctgcttctactacgtcgccaccacttacttccctctcctcccccaccctctctcctacttcgcctggcctctctactgggcctgccagggctgcgtcctaaccggcgtctgggtcatagcccacgagtgcggccaccacgccttcagcgactcc

SEQ ID NO: 27268 - DNA, 319 bp, Artificial
  Mutation in BnaA.FAD2.a introduced by TALE nuclease pair BnFAD2_T03
caggatccatgggtgcaggtggaagaatgcaagtgtctcctccctccacaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27269 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27270 - DNA, 388 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcacccgtcagtgcattgcgccatgcatgcactgcctccagagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27271 - DNA, 428 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgcgcgtaaccaccacacccgccagcgccctagcgcccgctcctttcgctttcttcccttcctttctcgccacgttcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27272 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctcccccaccctctcccttacctcgcctggcctctctactgggcctgccagggctgcgtcctaacgggcctctgggtcatcgcccacgaatgcggccaccacgccttcagcgactac

SEQ ID NO: 27273 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagccaacgagtgcggccaccacgccttcagcgactac

SEQ ID NO: 27274 - DNA, 394 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgccggtgctgtgccaggcccacggcttgaccccccagcaggtggtgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27275 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 27276 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctacttcgcctggcctctctactgggcctgccaagggtgcgtcctaaccggcgtctgggtcatagcccacgagtgcggccaccacgccttcagcgactac

SEQ ID NO: 27277 - DNA, 340 bp, Artificial
  Mutation in BnaA.FAD2.a introduced by TALE nuclease pair BnFAD2_T03
caggatccatgggtgcaggtggaagaatgcaagtacctcctccctccaagaagtctgaaaccgacaccatcaagcgcgtacggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27278 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctacttcgcctcgcctctctaccgggcctgccaggcctgcgtcctaaccggcgtctgggtcatcgcccacgagtgcggccaccacgccttcagcgactac

SEQ ID NO: 27279 - DNA, 402 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27280 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27281 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctccctccctcgctctttctcctacctcatctgggacatcatcatagcctcctgcttctactacgtcgccaccacctactgccctctcctcccgcaccctctctcccacttcgcctcgcctctctactgggcctgccagggctgcgtcctaacgggcctctgggtcatagcccacgagtgcggccaccacgccttcagcgactac

SEQ ID NO: 27282 - DNA, 388 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaggtacctcgcgaatgcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 27283 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27284 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctaatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27285 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggcttcgtcctaacgggcctctgggtcatagcccacgagtgcggccaccacgccttcagcgactac

SEQ ID NO: 27286 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 27287 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaacttaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtaatagcccacgagtgcggccaccacgccttcagcgactac

SEQ ID NO: 27288 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttgagaactcaagaaagcaatcccaccgcactgtttcaaacgctcgatccctcgctctttctcctacctcatctgggacatcatcatagcctcctgcttctactacgtcgccaccacttacttcactctcctccctcaccctctctcctacttcgcctggcctctctactgggcctgccaagggtgcgtcctaaccggcgtctgggtcatagcccacgagtgcggccaccacgccttcagcgactac

SEQ ID NO: 27289 - DNA, 350 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcctggcctctctactgggccggccagggctgcggcctaaccggcgtctgggtcatagcccacgagtgcggccaccacgccatcagcgactac

SEQ ID NO: 27290 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 27291 - DNA, 350 bp, Artificial
  Mutation in BnaA.FAD2.a introduced by TALE nuclease pair BnFAD2_T03
caggatccatgggtgcaggtggcagaatgcaagtgtctaatccctcaaaagagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcataacctcctgcttctactacgtccccaccacttacttccctttcctcccccaccctctctccttcgtccccagacctatctccagggccgcccttggatgcttcctaaccggcgtctggttcagatcccacgagtgttgccaccactccatcagcgactac

SEQ ID NO: 27292 - DNA, 337 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27293 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccaaggctgcgtcctaacgggcctctgggtcatagcccacgagtgcggccaccacgccttcagcgactac

SEQ ID NO: 27294 - DNA, 350 bp, Artificial
  Mutation in BnaA.FAD2.a introduced by TALE nuclease pair BnFAD2_T03
caggatccatgagtgcaggcggcagaatgcaagtgactccgccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaaccggcgtctgggtcatagcccacgagtgcggccaccacgccttcagcgactac

SEQ ID NO: 27295 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaacgggcctctgggtcatcgcccacgaatgcggccaccacgccttcaggactac

SEQ ID NO: 27296 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27297 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccatggctgcgtcctaaccggcgtctgggtcatagcccacgagtgcggccaccacgccttcagcgactac

SEQ ID NO: 27298 - DNA, 379 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggccacgatggcggcaacagccgctggagggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27299 - DNA, 347 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27300 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttgctccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcttggtcatagcccacgagtgcggccaccacgccttcagcgactac

SEQ ID NO: 27301 - DNA, 325 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtatagaactcaagaaagcaataccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27302 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27303 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtcttaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27304 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27305 - DNA, 456 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggctgttgccggtgctgtgccaggcccacggcttgaccccggagcaggtggtggccatcgccagcaatattggtggcaagcaggcgctggagacggtgcaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27306 - DNA, 383 bp, Artificial
  Mutation in BnaA.FAD2.a introduced by TALE nuclease pair BnFAD2_T03
caggatccatgggtgcagttggaagaatgcaagtggctcctccctccaaaaagtctgaaaccgacaacatcaagcgcgtaccctgcgagacaccgcccttcactgtaacgaccttttggaaacttcggcttcccctgaacgaactcaagaaagcaatcccaccgcactgtttcaaacgctcgatcactcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 27307 - DNA, 338 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggcctccacgccttcagcgactac

SEQ ID NO: 27308 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccgcgagtgcggccaccacgccttcagcgactac

SEQ ID NO: 27309 - DNA, 277 bp, Artificial
  Mutation in BnaA.FAD2.a introduced by TALE nuclease pair BnFAD2_T03
caggatccatgggtgcaggtggaagaatgcaagagtctcctccctccaaaaagtctgaaaccgacaacatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27310 - DNA, 349 bp, Artificial
  Mutation in BnaA.FAD2.a introduced by TALE nuclease pair BnFAD2_T03
caggatccatgggtgcaggtggaacaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctggtacatcatcatagcctcctggttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27311 - DNA, 351 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27312 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtccctgcgagacaccacccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27313 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgagtcatagcccacgagtgcggccaccacgccttcagcgactac

SEQ ID NO: 27314 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcagctgggacagcatcatagcctcctgcttctactacggcgccaccacttacttccctctcctccctcaccctctctcctacttcgcctggcctctctacggggcctgccagggctgcgtcctaacgggcctctgggtcatagcccacgagtgcggccaccacgccttcagcgactac

SEQ ID NO: 27315 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 27316 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgccctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27317 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgaaccctcgctctttctcctacctcatctgggacatcatcatagcctccttcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27318 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 27319 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaaggaagcaatcccaccgcactgtttcaaacgctcgatctctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 27320 - DNA, 344 bp, Artificial
  Mutation in BnaA.FAD2.a introduced by TALE nuclease pair BnFAD2_T03
caggatccatgggtgcaggtggaagaatgcaagtgactcctccctccaagaagtctgaaaccgacaccatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27321 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 27322 - DNA, 373 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacactgccaggcatcaaactaagcagaaggccatccgtcaaacgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 27323 - DNA, 350 bp, Artificial
  Mutation in BnaA.FAD2.a introduced by TALE nuclease pair BnFAD2_T03
caggatccatgggtgcaggtggcagaatgcaagtgtctactccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27324 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 27325 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27326 - DNA, 313 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacatcaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27327 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcattcagcgactac

SEQ ID NO: 27328 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactatgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27329 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 27330 - DNA, 412 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgttcaggagagcgttcaccgacaaacaacagataaaacgaaaggcccagtcttccgactgagccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27331 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatccagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27332 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcatccctcaccctctctcctacttcgcctggcctctctactgggcctgccagggctgcgtcctaaccggcgtctgggtcatagccaacgagtgcggccaccacgccttcagcgactac

SEQ ID NO: 27333 - DNA, 317 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27334 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacttcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 27335 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacagggcctgccagggctgcgtcctaaccggcgtctgggtcatagcccacgagtgcggccaccacgccttcagcgactac

SEQ ID NO: 27336 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27337 - DNA, 354 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtcggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggcaccacgccttcagcgactac

SEQ ID NO: 27338 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27339 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaacaccctcaaacgcgtcccctgcgagacaccaccattcactagacctcaagacagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27340 - DNA, 336 bp, Artificial
  Mutation in BnaA.FAD2.a introduced by TALE nuclease pair BnFAD2_T03
caggatccatgggtgcaggcggaagaatgcaagtctctcctccctccaaaaagtctgaaaccgacaacatcaagcgcgtaccctgcgagacaccgactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27341 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccgtcagcgactac

SEQ ID NO: 27342 - DNA, 327 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27343 - DNA, 317 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaccatccgcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27344 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 27345 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27346 - DNA, 349 bp, Artificial
  Mutation in BnaA.FAD2.a introduced by TALE nuclease pair BnFAD2_T03
caggatccatggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27347 - DNA, 360 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctggcctctctactgggcctgccagggctgcgtcctaaccggcgtctgggtcatagcccacgagtgcggccaccacgccttcagcgactac

SEQ ID NO: 27348 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacatgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27349 - DNA, 401 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27350 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccatcagcaactac

SEQ ID NO: 27351 - DNA, 347 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27352 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27353 - DNA, 352 bp, Artificial
  Mutation in BnaA.FAD2.a introduced by TALE nuclease pair BnFAD2_T03
caggatccatgggtgcaggcggcagaatgcaagtgtctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27354 - DNA, 348 bp, Artificial
  Mutation in BnaA.FAD2.a introduced by TALE nuclease pair BnFAD2_T03
caggatccatgggtgcaggtggaagaatgcaagtatctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27355 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27356 - DNA, 349 bp, Artificial
  Mutation in BnaA.FAD2.a introduced by TALE nuclease pair BnFAD2_T03
caggatccatgggtgcaggtggaagaatgtaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27357 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctcccctcccccaccctctcccttacctcgcctggcccctctactgggcctgccaaggctgcgtcctaacgggcctctgggtcatcgcccacgaatgcggccaccacgccttcagcgactac

SEQ ID NO: 27358 - DNA, 304 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaacctacaacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27359 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgagaactcaagaaaacaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaaccggcgtctgggtcatagcccacgagtgcggccaccacgccttcagcgactac

SEQ ID NO: 27360 - DNA, 350 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaacgggcctctgggtcatagcccacgagtgcggccaccacgccttcagcgactac

SEQ ID NO: 27361 - DNA, 345 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27362 - DNA, 343 bp, Artificial
  Mutation in BnaA.FAD2.a introduced by TALE nuclease pair BnFAD2_T03
caggatcctgggtgcaggtggaagaatgcaagtgtctcctccctccaagaagtctgaaaccgacaccattaagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 27363 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgacctcaagaaagcaatcccaccgcactgtttcaaacgctcgatccctcgctctttctcctacctcatctgggacatcatcatagcctcctgcttctactacgtcgccaccacttacttccctctcctccctcgccctctctcctacttcgcctggcctctctactgggcctgccagggctgcgtcctaaccggcgtctgggtcatagcccacgagtgcggccaccacgccttcagcgactac

SEQ ID NO: 27364 - DNA, 349 bp, Artificial
  Mutation in BnaA.FAD2.a introduced by TALE nuclease pair BnFAD2_T03
caggatccatgggtgcaggtggaagaatgtaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27365 - DNA, 340 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtacggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27366 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtatgaaaccgacaacatcaagcgcgtaccctgcgagacaccacccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcatcctaaccggcgtctgggtcatagcccacgagtgcggccaccacgccttcagcgactac

SEQ ID NO: 27367 - DNA, 410 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgactcaagacgatagttaccggataaggcgcagcggtcgggctgaacggggggtcgaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27368 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccgatctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 27369 - DNA, 318 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27370 - DNA, 349 bp, Artificial
  Mutation in BnaA.FAD2.a introduced by TALE nuclease pair BnFAD2_T03
caggatccatgtgtgcaggtggaagaattcaagtctctcctccctccagctcccccggaaccaacaccctcaaacgcgtcccctgcgagacaccaccattcactcttacctcaagaaagcaatcccaccccactgtttcaaacgctcgatccctcgctctttctcctacctcatctgggacatcatcatagcctcctgcttctactacgtctccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27371 - DNA, 338 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27372 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27373 - DNA, 397 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagcaggtggtggccatcgccagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27374 - DNA, 351 bp, Artificial
  Mutation in BnaA.FAD2.a introduced by TALE nuclease pair BnFAD2_T03
caggatccatgggtgcaaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27375 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcatctgggacatcatcatagcctcctgcttctactacgtcgccaccacttacttccctctcctccatcaccctctctcctacttcgcctggcctctctactgggcctgccagggctgcgtcctaaccggcgtctgggtcatagcccacgagtgcggccaccacgccttcagcgactac

SEQ ID NO: 27376 - DNA, 345 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaattccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27377 - DNA, 380 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgatggccaccacctgctccggggtcaagccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27378 - DNA, 350 bp, Artificial
  Mutation in BnaA.FAD2.a introduced by TALE nuclease pair BnFAD2_T03
caggatccatgggtgcaggtggaagaatgcatgtgtctcctccctccaaaaagtctgaaaccgacaacatcaagcgcgtaccctgcgagacaccgccattcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27379 - DNA, 357 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttttgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27380 - DNA, 271 bp, Artificial
  Mutation in BnaA.FAD2.a introduced by TALE nuclease pair BnFAD2_T03
caggatccatgggtgcaggtggaagaatgcaagtgtctcctccctcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 27381 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgaactcaagaaagcaatcccaccgcactgtttcaaacgctcgatccctcgctctttctcctacctcatctgggacatcatcatatcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27382 - DNA, 350 bp, Artificial
  Mutation in BnaA.FAD2.a introduced by TALE nuclease pair BnFAD2_T03
caggatccatgggtgcaggtggcagaatgcaagtctctcctccctccagctcccccgaaaccaaaaccctcaaacacgtcccctgcgagacaccacccttcactctagacctcaagaaagcaatcccacctcactgcttcaaacgctccatccctcgctctttctcctacctcatcagggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27383 - DNA, 317 bp, Artificial
  Mutation in BnaA.FAD2.a introduced by TALE nuclease pair BnFAD2_T03
caggatcatgggtgcaggtggacgaatgcaagtgtctcctccctccaaaaagtctgaaaccgacaacatcaagcgcgtaccctgcgagacaccgccctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27384 - DNA, 287 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27385 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttcttctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27386 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 27387 - DNA, 366 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgatggccaccacctgctccggggtcaagccgaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 27388 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27389 - DNA, 344 bp, Artificial
  Mutation in BnaA.FAD2.a introduced by TALE nuclease pair BnFAD2_T03
caggatccatggggtgcaggtggaagaatgcaagtgtctcctccctccaagaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27390 - DNA, 317 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatacgcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27391 - DNA, 346 bp, Artificial
  Mutation in BnaA.FAD2.a introduced by TALE nuclease pair BnFAD2_T03
caggatccatgggtgcaggtgccagaatgcaagtgtctcctccctccaagaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 27392 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27393 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggccactctactgggcctgccaaggctgcgtcctaacgggcctctgggtcatcgcccacgagtgcggccaccacgccttcagcgactac

SEQ ID NO: 27394 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27395 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgttccaaacgctcgacccctcgctctttctcctacctcatctgtgacatcatcataccctcctgcttctactacgtcgccaccacttacttctctctcctccctcaccctctctcctacttcgcctgacctctctactgggcctgccagggctgcgtcctaaccggcgtctgggtcatagcccacgagtgcggccaccacgccttcagcgactac

SEQ ID NO: 27396 - DNA, 327 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27397 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaaacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27398 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 27399 - DNA, 346 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 27400 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27401 - DNA, 381 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactttcgaggcatttctgtcctggctggtctagaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27402 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27403 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27404 - DNA, 350 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 27405 - DNA, 337 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27406 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 27407 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 27408 - DNA, 421 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgcgcgtaaccaccacacccgccagcgccctagcgcccgctcctttcgctttcttcccttcctttctcgccacgttcgagaactcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 27409 - DNA, 343 bp, Artificial
  Mutation in BnaA.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27410 - DNA, 350 bp, Artificial
  Mutation in BnaA.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27411 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27412 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggccatagcccacgagtgcggccaccacgccttcagcgactac

SEQ ID NO: 27413 - DNA, 342 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27414 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgtgagacaccgcccttcacagtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcctggcctctctactgggcctgccaagggtgcgtcctaaccggcgtctgggtcatagcccacgagtgcggccaccacgccttcagcgactac

SEQ ID NO: 27415 - DNA, 349 bp, Artificial
  Mutation in BnaA.FAD2.a introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27416 - DNA, 403 bp, Artificial
  Mutation in BnaA.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccgcccttcactgttagggaactcgcgaatgcatctagatccaatgatcatgaacggagaattaaggagaactcaagaaagcaatcccaccgcactgtttcaaacgctcgatccctcgctctttctcctacctcatctgcgacatcatcatagcctcctccttctactacctcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27417 - DNA, 349 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatatcccacgaatgcggccaccacgccttcagcgactac

SEQ ID NO: 27418 - DNA, 342 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27419 - DNA, 280 bp, Artificial
  Mutation in BnaA.FAD2.a introduced by TALE nuclease pair BnFAD2_T03
caggatccatgggtgcaggtggaagaatgcaagtgtctcctccctccaagaagcccgaaaccgacaccatcaagcgcgtaccctgcgagacaccgcccttcactgtcgggacatcatcatagcctcctgcttctactacgtcgccaccacctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27420 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaagtcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27421 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27422 - DNA, 295 bp, Artificial
  Mutation in BnaA.FAD2.a introduced by TALE nuclease pair BnFAD2_T03
caggatccatgggtgcaggtggcagaatgcaagtgtctcctccccccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccactagtgcggccaccacgccttcagcgactac

SEQ ID NO: 27423 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 27424 - DNA, 349 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27425 - DNA, 349 bp, Artificial
  Mutation in BnaA.FAD2.a introduced by TALE nuclease pair BnFAD2_T03
caggatccatggggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcacagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27426 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 27427 - DNA, 349 bp, Artificial
  Mutation in BnaA.FAD2.a introduced by TALE nuclease pair BnFAD2_T03
caggatccattggtgcaggtggaagaatgcaagtgtctcctccctccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctttactgggcctgccaaggctgcgtcctaacgggcctctgggtcatagcccacgagtgcggccaccacgccttcagcgactac

SEQ ID NO: 27428 - DNA, 349 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27429 - DNA, 330 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgacgggagaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27430 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctactgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27431 - DNA, 329 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27432 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27433 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctaaaccgcgtcccctgcgagccaccacccttcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27434 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctccacttcttccaccgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27435 - DNA, 302 bp, Artificial
  Mutation in BnaA.FAD2.a introduced by TALE nuclease pair BnFAD2_T03
caggatccatgggtgcaggtggaagaatgcaagtgtctcctccctccgagaagtctgaaaccgacaccatcaagcgcgtaccctgcgagacaccaccattcactcagacctcaagaaagcaatcccacctcactgcttcaaacgctccatcccacgctccttctcctcttcgacatcatcatctcctcccccaccctctcccttacctcgcctgacccctctactgggcctgccagggctgcgtcctaaccggcgtctgggtcatagcccacgagtgcggccaccacgccttcagcgactac

SEQ ID NO: 27436 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttaagcgactac

SEQ ID NO: 27437 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27438 - DNA, 354 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtcaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27439 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 27440 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacttcttccaccgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27441 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27442 - DNA, 333 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 27443 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtgaacgctctcctgagtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcaagggtgcgtcctaaccggcgtctgggtcatagcccacgagtgcggccaccacgccttcagcgactac

SEQ ID NO: 27444 - DNA, 378 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggctgttgccggtgctgtgccaggcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27445 - DNA, 349 bp, Artificial
  Mutation in BnaA.FAD2.a introduced by TALE nuclease pair BnFAD2_T03
catgatccatgggtgcaggtggcagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcctcttctacatcctcgtctcctcctccctctaccacctctccacagcctacttccctctcctcccccaccctctcccttccctcgcctggcccctctactgggcctgccagggctgcgtcctaaccggcgtctgggtcatagcccacgagtgcggccaccacgccttcagcgactac

SEQ ID NO: 27446 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27447 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27448 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcacctgggacatcatcatagccccctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27449 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgcccttcagcgactac

SEQ ID NO: 27450 - DNA, 340 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccacctcaagaaagcaatcccaccgcactgtttcaaacgctcgatccctcgctctttctcctacctcctcttcgacatcctcgtctcctcctccctctaccacctctccacagcctacttccctctcctcccccaccctctcccttccctcgcctggcccctctactgggcctgccagggctgcgtcctaaccggcgtctgggtcatagcccacgagtgcggccaccacgccttcagcgactac

SEQ ID NO: 27451 - DNA, 350 bp, Artificial
  Mutation in BnaA.FAD2.a introduced by TALE nuclease pair BnFAD2_T03
caggatccatgggtgcaggtggcagaatgcaagtgtctcctccctccaagaagcctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27452 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27453 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27454 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27455 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaaagcaatcccaccgcactgtttcaaacgctcgatccctcgctctttctcctacctcatctgggacatcatcatagcctcctgcttctactacgtcgccaccacttacttccctctcctccctcgccctctctcccacttcgcctggcctctctactgggcctgccagggctgcgtcctaaccggcgtctgggtcatatttctttagtgcggccaccactccttcagcgactac

SEQ ID NO: 27456 - DNA, 345 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27457 - DNA, 350 bp, Artificial
  Mutation in BnaA.FAD2.a introduced by TALE nuclease pair BnFAD2_T03
caggatccatgggtgcaggtggaagaatgcaagtgtctcccccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27458 - DNA, 469 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtgctgtgccaggcccacggcttgaccccccagcaggtggtggccatcgccagcaatggcggtggcaacagccgctggggcagcagccactggtaacagggttcaggggaagccttaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27459 - DNA, 425 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgctttccagtcggtaaacctgtcgtgccagctgcattaatgaatcggccaacgcgcggggagaggcggtttgcgtgaactcaagaaagcaatcccaccgcactgtttcaaacgctcgatccctcgctctttctcctacctcatctgggacatcatcatagcttcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27460 - DNA, 305 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgaactcaagaaagcaatcccaccgcactgtttcaaacgctcgacccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27461 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 27462 - DNA, 277 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27463 - DNA, 350 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27464 - DNA, 351 bp, Artificial
  Mutation in BnaA.FAD2.a introduced by TALE nuclease pair BnFAD2_T03
caggatccatgggtgcaggtggaagaatgcaagtcactcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27465 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaaacaatcccaccgcactgctgcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27466 - DNA, 338 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctccaaaaacacacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27467 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27468 - DNA, 354 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggagaaatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27469 - DNA, 377 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcgctcggtcgttcggctgcggcgagcggtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27470 - DNA, 384 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttccccggagcaggtggtggccatcgccagcaatattggtggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27471 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27472 - DNA, 308 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 27473 - DNA, 394 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgccggtgctgtgccaggcccacggcttgaccccccagcaggtggtgggaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 27474 - DNA, 383 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaacgaccttttggaaacttcggcttcccctgaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27475 - DNA, 326 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27476 - DNA, 348 bp, Artificial
  Mutation in BnaA.FAD2.a introduced by TALE nuclease pair BnFAD2_T03
caggatccatgggtgcaggtggaagaatgcaagtgtctcctctctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27477 - DNA, 406 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgccgtcgggcttcctggagccgcccgatttagagcttgacggggaaagccggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccggcctctctactgggcctgccagggctgcgtcctaacgggcctctgggtcatagcccacgagtgcggccaccacgccttcagcgactac

SEQ ID NO: 27478 - DNA, 340 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtacggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 27479 - DNA, 431 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcgcgaacgtggcgagaaaggaagggaagaaagcgaaaggagcgggcgctagggcgctggcaagtgtagtggttacgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27480 - DNA, 329 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccgagacctcaagaaagcaatcccaccgcactgtttcaaacgctcgatcccaccctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27481 - DNA, 396 bp, Artificial
  Mutation in BnaA.FAD2.a introduced by TALE nuclease pair BnFAD2_T03
caggatccatgggtgcaggtggaagaatgcaagtgtctcctccctacaaaaagtctgaaaccgacaacatcaagcgcgtaccctgcgagacaccgcccttcactgtcggttcctggccttttgctggccttttgctcacatgttctttccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggggcatagcccacgagtgcggccaccacgccttcagcgactac

SEQ ID NO: 27482 - DNA, 411 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaaagcaatcccaccgcactgtttcaaacgctcgatccctcactctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27483 - DNA, 343 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27484 - DNA, 351 bp, Artificial
  Mutation in BnaA.FAD2.a introduced by TALE nuclease pair BnFAD2_T03
caggatccatgggtgcaggtggaagaatgcaagtttctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccagcgtctgggtcatagcccacgagtgcggccaccacgccttcagcgactac

SEQ ID NO: 27485 - DNA, 304 bp, Artificial
  Mutation in BnaA.FAD2.a introduced by TALE nuclease pair BnFAD2_T03
caggatccatgggtgcaggtggaagaatgcaagtgtctcctccctccaaaaaccctgaaaccgacaacatcaaacaatcccaccgcactgcttcaaacgctcgatccctcgctctttctcctacatcatctgggacatcatcatagcctcctgcctctactacgtcgccacctcttacttccctctcctccctctccctctcccttacctcgcctggcccctctactgggcctgccaaggctgcgtcctaacgggcctctgggtcatcgcccacgaatgcggccaccacgccttcagcgactac

SEQ ID NO: 27486 - DNA, 350 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27487 - DNA, 319 bp, Artificial
  Mutation in BnaA.FAD2.a introduced by TALE nuclease pair BnFAD2_T03
caggatccatgggtgcaggttgaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 27488 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcccctggaaccaacaccctcaaacgcgtcccctgcgagacaccaccattcaagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27489 - DNA, 380 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtcgatggccaccacctgctccggggtcaagccgaactcaagaaagcaatcccaccgcactgtttcaaacgctcaatccctcgctctttctcctacctcatctgggacatcatcatagcctcctgcttctactacgtcgccaccacttacttccctctcctccctcaccctctctcctacttcgcctcgcctctctactgggcctgccagggctgcgtcctaaccggcgtctgggtcatagcccacgagtgcggccaccacgccttcagcgactac

SEQ ID NO: 27490 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctgctacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27491 - DNA, 338 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcgtctgggtcatcgcccacgaatgcggccaccacgccttcagcgactac

SEQ ID NO: 27492 - DNA, 356 bp, Artificial
  Mutation in BnaA.FAD2.a introduced by TALE nuclease pair BnFAD2_T03
caggatccatgggtgcagctggaagaatgcaagtgtgtcctccctccaaaaagtctgaaaccgacaacataaagcgcgtaccctgcgagacaccgcccttcacttcttccaccgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcttctgggtcatagcccacgagtgcggccaccacgccctcagcgactac

SEQ ID NO: 27493 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccgcaccctctctccgacatcgcctggccaaacaacagggcctgccagggatgcggccgaaccggcgactgggacatagcccacgagtgaggccaccacgccaacagcaactac

SEQ ID NO: 27494 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27495 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaataaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27496 - DNA, 450 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgcggcgagctttgatcaacgaccttttggaaacttcggcttttggatctagatgcattcgcgaggtacctacaacttttgtatacaaagttggcattataaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27497 - DNA, 344 bp, Artificial
  Mutation in BnaA.FAD2.a introduced by TALE nuclease pair BnFAD2_T03
caggatccatgggtgcaggtgacagaatgcaagtgtctactccctccaaaaagtctgaaaccgacaacatcaagcgcgtaccctgcgagacaccgcccttcactgtcgatggccaccacctgctccggggtcaagccgaactcaagaaagcaatcccacctcactgcttcaaacgctccatcccacgctccttctcctcttcgacatcatcatctcctcctccgctcctccctcaccctctctcctacttcgcctggcctctctactgggcctgccagggctgcggcccaaccggcgtctgggtcatagcccgcgagtgcggccaccacgccttcagcgactac

SEQ ID NO: 27498 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27499 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcatcgactac

SEQ ID NO: 27500 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcacgaaagcaatcccaccgcactgtttccaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27501 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtccgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27502 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 27503 - DNA, 287 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27504 - DNA, 347 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 27505 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 27506 - DNA, 354 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27507 - DNA, 420 bp, Artificial
  Mutation in BnaA.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcttgccggtgctgtgccaggcccacggcttgaccccccagcaggtggtggccatcgccagcaatggcggtggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27508 - DNA, 341 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactcgacctcaagaaagcaatcccacctcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27509 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccccctctcctacttcgcctggcctctctactgggcctgccagggctgcgtcctaaccggcgtctgggtcatagcccacgagtgcggccaccacgccttcagcgactac

SEQ ID NO: 27510 - DNA, 349 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaaccggcgtctgggtcatagcccacgagtgcgtccaccacgccttcagcgactac

SEQ ID NO: 27511 - DNA, 363 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcaccatcaagaaagcaatcccaccgcactgtttcaaacgctcgatccctcgctctttctcctacctcatctgggacatcatcatagcctcctgcttctactacgtcgccaccacttacttccctctcctccctcaccctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27512 - DNA, 431 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcgcgaacgtggcgagaaaggaagggaagaaagcgaaaggagcgggcgctagggcgctggcaagtgtagtggttacgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27513 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27514 - DNA, 348 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaattcggccaccacgccttcagcgactac

SEQ ID NO: 27515 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27516 - DNA, 308 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27517 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccgtcagcgacta

SEQ ID NO: 27518 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatagcccacgagtgcggccaccacgccttcagcgactac

SEQ ID NO: 27519 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 27520 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcgtagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27521 - DNA, 422 bp, Artificial
  Mutation in BnaA.FAD2.a introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactgtcggcaagcaggcgctggagacggtccagcggctgttgccggtgctgtgccaggcccacggcttgaccacggcagaactcaagaaagcaatcccaacgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27522 - DNA, 331 bp, Artificial
  Mutation in BnaA.FAD2.a introduced by TALE nuclease pair BnFAD2_T03
caggatccatgggtgcaggtggcagaatgcaagtctctcctccctccagctcccccgaaaccaaaaccctcaaacgcgtcccctgcgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 27523 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctggcctctctactgggcctgccagggctgcgtcctaaccggcgtctgggtcatagcccacgagtgcggccaccacgccttcagcgactac

SEQ ID NO: 27524 - DNA, 345 bp, Artificial
  Mutation in BnaA.FAD2.a introduced by TALE nuclease pair BnFAD2_T03
caggatccatgggtgcaggtggaagaatgcaagtatctcctccctccagctcccccggaaccaacaccctcaaacgcgtcccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27525 - DNA, 340 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtacggctgcggcgagcggagaactcaagaaagcaatcccaccgcactgtttcaaacgctcgatccctcgctctttctcctacctcatctgggacatcatcatagcctcctgcttctactacgtcgccaccacttacttccatctcctcccccaccctctctcctacttcgcctggcctctctactgggcctgccagggctgcgtcctaacgggcgtctgggtcatagcccacgagtgcggccaccacgccttcagcgactac

SEQ ID NO: 27526 - DNA, 295 bp, Artificial
  Mutation in BnaA.FAD2.a introduced by TALE nuclease pair BnFAD2_T03
caggatccatgggtgcatgtggaagaatgcaagtgtctcctccctccaaaaagtctgaaaccgacaacatcaagcgcgtaccctgcgagacaccgcccttcgctctttctcctacctcatctgtgatatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27527 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcggcctaaccggcgtctgggtcatagcccacgagtgcggccaccacgccttcagcgactac

SEQ ID NO: 27528 - DNA, 295 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27529 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 27530 - DNA, 350 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacaccatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 27531 - DNA, 384 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccatgcgagacaccgcccttcagactgagcctttcgttttatctgttgtttgtcggtgaacgctctcctgagtaggtcaaatccgctctgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 27532 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 27533 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27534 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaaacgcgtaccctgcgagacaccgcccttcactttgctccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccggggctgcgtcctaaccggcgtctgggtcatagcccacgagtgcggccaccacgccttcagcgactac

SEQ ID NO: 27535 - DNA, 333 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27536 - DNA, 339 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacacggccctctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27537 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctaatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27538 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 27539 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27540 - DNA, 401 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgcccgccaccctccgggccgttgcttcacaacgttcaaatccgctcccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27541 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 27542 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27543 - DNA, 368 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagcaatggcggtggctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27544 - DNA, 360 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27545 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacaccttcagcgactac

SEQ ID NO: 27546 - DNA, 350 bp, Artificial
  Mutation in BnaA.FAD2.a introduced by TALE nuclease pair BnFAD2_T03
caggatccattggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27547 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27548 - DNA, 349 bp, Artificial
  Mutation in BnaA.FAD2.a introduced by TALE nuclease pair BnFAD2_T03
caggatccatgggtgcaggtggaagaatgtaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagttcggccaccacgccttcagcgactac

SEQ ID NO: 27549 - DNA, 309 bp, Artificial
  Mutation in BnaA.FAD2.a introduced by TALE nuclease pair BnFAD2_T03
caggatccatgggtgcaggtggaagaattcaagtgtctcctccctccaaaaagtctgaaaccgacaacatcaaaccgacaacacccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 27550 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27551 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27552 - DNA, 336 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtagaactcaagaaagcaatctcacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 27553 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcaagggtgcgtcctaaccggcgtctgggtcatagcccacgagtgcggccaccacgccttcagcgactac

SEQ ID NO: 27554 - DNA, 411 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggcctggcacagcaccggcaacagccgctggaccgtctccagcgcctgcttgccaccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27555 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtaatagcccacgagtgcggccaccacgccttcagcgactac

SEQ ID NO: 27556 - DNA, 384 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagactgagcctttcgttttatctgttgtttgtcggtgaacgctctcctgagtaggtcaaatccgctctgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27557 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagaactcaagaaagcaatcccaccgcactgtttcaaacgctcgatccctcgctctttctcctacctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgcccttcagcgactac

SEQ ID NO: 27558 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaagggtgcgtcctaacgggcctctgggtcatcgcccacgaatgcggccaccacgccttcagcgactac

SEQ ID NO: 27559 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactcc

SEQ ID NO: 27560 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactctttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27561 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27562 - DNA, 392 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtaatctggaacatcgtatgggtaatcgatgaccttacgtttaaactcaagaaagcaatcccaccgcactgtttcaaacgctcgatccctcgctctttctcctacctcatctgggacatcatcatagcctcctgcttctactacgtcgccaccacttacttccctcccctccctcaccctctctcctactgcgcctggcctctctactgggcctgccagggctgcgtcctaaccggcgtctgggtcatagcccacgagtgcggccaccacgccttcagcgactac

SEQ ID NO: 27563 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctcccttaccctctctcctacttcgcctggcctctctactgggcctgccagggctgcgtcctaaccggcgtctgggtcatagcccacgagtgcggccaccacgccttcagcgactac

SEQ ID NO: 27564 - DNA, 398 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggcgactgccctgctgcgtaacatcgttgctgctccataacatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27565 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27566 - DNA, 391 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacccgcttcctcgctcactgactcgctgcgctcggtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggcggcgtcctaaccggcgtctgggtcatagcccacgagtgcggccaccacgccttcagcgactac

SEQ ID NO: 27567 - DNA, 348 bp, Artificial
  Mutation in BnaA.FAD2.a introduced by TALE nuclease pair BnFAD2_T03
caggatcatgggtgcaggtggaagaatgcaagtgtctcctccctccaaaaagtctgaaaccgacaacatcaagcgcgtaccctgcgagacaccgcccttcactgagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27568 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27569 - DNA, 357 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27570 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgacgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27571 - DNA, 370 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggtgaacgctctcctgagtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27572 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 27573 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggtctctctactgggcctgccagggctgcgtcctaaccggcgtctgggtcatagcccacgagtgcggccaccacgccttcagcgactac

SEQ ID NO: 27574 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagactgaaaccgacaacatcaagcgcgtaccctgcgagacaccgcccttcactgttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgtgtgcggccaccacgccttcagcgactac

SEQ ID NO: 27575 - DNA, 350 bp, Artificial
  Mutation in BnaA.FAD2.a introduced by TALE nuclease pair BnFAD2_T03
caggatccatgggtgcaggtggcagaatgcaagtgtcgcctccctccaagaagcctgaaaccgacaccatcaagcgggtaccctgcgagacaccgcccttcactgtaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccagggctgcgtcctaaccggcgtctgggtcatagcccacgagggcggccaccacgccttcagcgactac

SEQ ID NO: 27576 - DNA, 348 bp, Artificial
  Mutation in BnaA.FAD2.a introduced by TALE nuclease pair BnFAD2_T03
caggatccatgggtgcaggtggaagaatgcaagtgtctactccctcaaagaagtctgaaaccgacaccatcacgcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27577 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcggccaccacgccttcagcgactac

SEQ ID NO: 27578 - DNA, 411 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgtacgtgccccacgagtacatcgagctgatcgagatcgcccggaacagcacccaggaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcatggcctctctactgggcctgccagggctgcgtcctaaccggcgtctgggtcatagcccacgagtgcggccaccacgccttcagcgactac

SEQ ID NO: 27579 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27580 - DNA, 350 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27581 - DNA, 401 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcccgccaccctccgggccgttgcttcacaacgttcaaatccgctcccggagaactcaagaaagcaatcacaccgcactgtttcaaacgctcgatccctcgccctttctcctacctcatctggtacatcagcatagcctcctgcttctactacgtcgccaccacgtacttccctcccctccctcacccgctctcctacttcgcctggcctctctactgggcctgccaagggtgcgtcctaaccggcgtctgggtcatagcccacgagtgcggccaccacgccttcagcgactac

SEQ ID NO: 27582 - DNA, 404 bp, Artificial
  Mutation in BnaA.FAD2.a introduced by TALE nuclease pair BnFAD2_T03
caggatctatgggtgcaggtggaagaatgcaagtgtctcctccctccaaaaagtctgaaaccgacaacatcaagcgcgtaccctgcgagacaccgcccttcactgtcaaccggatcaaagagttcctccgccgctggacctaccaaggcaacgctatgttctaactcaagaaagcaatcccaccgcactgtttcaaacgctcgatccctcgctctttctcctacctcatctgggacatcatcatagcctccggcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27583 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggcttcgtcctaaccggcgtctgggtcatagcccacgagtgcggccaccacgccttcagcgactac

SEQ ID NO: 27584 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgagtgcggccaccacgccttcagcgactac

SEQ ID NO: 27585 - DNA, 308 bp, Artificial
  Mutation in BnaA.FAD2.a introduced by TALE nuclease pair BnFAD2_T03
caggatccatgggtgcaggtggaagaatacaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27586 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaccatcaagcgcgtaccctgcgagacaccgcccttcactgtgaactcacgaaagcaatcccaccgcactgtttcaaacgctcgatccctcgctctttctcctacctcatctggcacatcatcatagcctcctgcttctactacgtcgccaccacctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27587 - DNA, 447 bp, Artificial
  Mutation in BnaA.FAD2.a introduced by TALE nuclease pair BnFAD2_T03
caggatccatgggtgcaggttgaagaatgcaagtgtctcctccctccaagaagtctgaaaccgacaccatcaagcgcgtaccctgcgagacaccccagcaggtggtggccatcgccagcaataatggtggcaagcaggcgctggagacggtgctgtgccaggcccacggcttgaccccccagcaggtggtggccatcgccagcaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27588 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 27589 - DNA, 327 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcatacttcgcctggcctctctactgggcctgccagggctgcgtcctaaccggcgtctgggtcatagcccacgagtgcggccaccacgccttcagcgactac

SEQ ID NO: 27590 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27591 - DNA, 351 bp, Artificial
  Mutation in BnaA.FAD2.a introduced by TALE nuclease pair BnFAD2_T03
catgatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27592 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27593 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 27594 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 27595 - DNA, 351 bp, Artificial
  Mutation in BnaA.FAD2.a introduced by TALE nuclease pair BnFAD2_T03
cacgatccatgggtgcaggtggaagaatgcaagtgtttcctccctccaaaaagtctgaaaccgacaacatcaagcgcgtaccctgcgagacaccgcccttcactgtcagaactcaagaaagcaatcccaccgccctgtttcaaacgctccatccctcgctctttctcctacctcatctgggacatcatcatagcctcctgcttctactacgtcgccaccacttacttccctctcctccctcaccctctctccttcttcgccaagcctctctactgggcctgccagtactgcgtcctgaccggcgtctgggtcatagcccacgagtgcggccaccacgccttcagcgactac

SEQ ID NO: 27596 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggagaactcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 27597 - DNA, 419 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgtgagacaccgcccttcactgtccgactgagcctttcgttttatctgttgtttgtcggtgaacgctctcctgagtaggacaaatcagccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27598 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27599 - DNA, 479 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgctcactgcccgctttccagtcgggaaacctgtcgtgccagctgcattaatgaatcggccaacgcgcggggagaggcggtttgcgtattgggggctcttccgcttcctcgctcactgactcgctgcgctcggagacctcaagaaagcaagcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27600 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgactccccctggcctctctactgggcctgccagggctgcgtcctaaccggcgtctgggtcatagcccacgagtgcggccaccacgccttcagcgactac

SEQ ID NO: 27601 - DNA, 348 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcacgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttagcgactac

SEQ ID NO: 27602 - DNA, 396 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggttcctggccttttgctggccttttgctcacatgttctttccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggtctctctactgggcctgccagggctgcgtcctaaccggcgtctgggtcatagcccacgagtgcggccaccacgccttcagcgactac

SEQ ID NO: 27603 - DNA, 290 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27604 - DNA, 351 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 27605 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27606 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27607 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagccacctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27608 - DNA, 373 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacattaaccagctgcattaatgaatcggccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggactgcgtcctaaccggcgtctgggtcatagcccacgagtgcggccaccacgccttcagcgactac

SEQ ID NO: 27609 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgtgagacaccgcccttcactgtagaactcaagaaagcaatcccaccgcactgttgcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27610 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtcataaaccgacaacatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27611 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27612 - DNA, 421 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactatttgatgcctggcagttccctactctcgccagcaataatggtggcaagcaggcgctggagacggtccagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27613 - DNA, 337 bp, Artificial
  Mutation in BnaA.FAD2.a introduced by TALE nuclease pair BnFAD2_T03
caggatccatgggtgcaggtggaagaatgcaagtgtctcctcccttcaaaaagtctgaaaccgacaacatcaagcgcgtaccctgcgagacaccgcccttcactgtgagaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27614 - DNA, 285 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccgggtacgcgcttgatgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27615 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggagaactcaagaaagcaatcccaccgcactgtttcaaacgctcaatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27616 - DNA, 430 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgaaacaccgcccttccatttggtacaccgccctacaccgcccttcacacgcccgccataaactgccaggcatcaaactaagcagaaggccatcctgacggagaactcaagagagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27617 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtccgaaaccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27618 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagtactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatcgcccacgaatgcggccaccacgccttcagcgactac

SEQ ID NO: 27619 - DNA, 428 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtgctgtgccaggcccacggcttgaccccggagcaggtggtggccatcgccagccacgatggcggcaagcaggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27620 - DNA, 369 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggtggtttgtttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27621 - DNA, 469 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagccgctggaccgtctccagcgcctgcttgccaccgccattgctggcgatggccaccacctgctggggggtcaagccgtgggcctggcacagcaccggcaacagccgctggagatcggagaactcaagaaagcaatcccaccgcactgttgcaaacgctcgatccctcgctctttctcctacctcatctgggacatcatcatagcctcctgcttctactacgtcgccaccacttacttccctctcctccctcaccctctctcctacttcgcctggcctctctacggggcctgccaaggctgcgtcctaacgggcctctgggtcatcgcccacgaatgcggccaccacgccttcagcgactac

SEQ ID NO: 27622 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27623 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27624 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27625 - DNA, 319 bp, Artificial
  Mutation in BnaA.FAD2.a introduced by TALE nuclease pair BnFAD2_T03
caggatccatgggtgcaggtggaagaatgcaagtctctcctccctccaaaaagactgaaaccgacaacctcaagcgcgtaccctgcgagacaccacccttcactgtttcaaccgctcgaaccctcgctctttctcctacctcatctggcacctcatcatagccttctgcttctactacgtcgccaccacctacttccctcgcctccctcaccctctctcctacttcgcctggcctctctactgggcctgccagggctgcgtcctaaccggcgtctgggtcatagcccacgagtgcggccaccacgccttcagcgactac

SEQ ID NO: 27626 - DNA, 329 bp, Artificial
  Mutation in BnaA.FAD2.a introduced by TALE nuclease pair BnFAD2_T03
caggatccatgggtgcaggtggaagaatgcaagtgtatcctccctccaaaaagactgaaaccgacaacatcaagagcgtaccctgcgagacaccgcccttcatcccaccgcactgtttcaaacgctcgatccctcgctctttctcccacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27627 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 27628 - DNA, 415 bp, Artificial
  Mutation in BnaA.FAD2.a introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactcttggccaccacctgctgaggggtcaagccgtgggcctggcacagcaccggcaacagccgctggaggagacctcaagaaagcaatcccacctcactgcttcaaacgctcgatccctcgctctttctcctacctcatctgggacatcatcatacccccctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactcc

SEQ ID NO: 27629 - DNA, 351 bp, Artificial
  Mutation in BnaA.FAD2.a introduced by TALE nuclease pair BnFAD2_T03
caggatccatgggtgcatgtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27630 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27631 - DNA, 466 bp, Artificial
  Mutation in BnaA.FAD2.a introduced by TALE nuclease pair BnFAD2_T03
caggatccatgggtgcatgtggaagaatgcaagtctctcctccctccagctcccccggaaccgacaccatcaagcgcgtaccctgcgagacaccgcccttcactgtggtccagcgcctgcttgccgccatcgtggctggcgatggccaccacctgctccggggtcaagccgtgggcctggcacagcaccggcaacagccgctggaccgtctccagcgcctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27632 - DNA, 379 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggtcatagcattggatcggatcccgggcccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27633 - DNA, 380 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgatggccaccacctgctccggggtcaagccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 27634 - DNA, 337 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27635 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggactgcgtcctaaccggcgtctgggtcatagcccacgagtgcggccaccacgccttcagcgactac

SEQ ID NO: 27636 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtccgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27637 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctacgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27638 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggccgcgtcctaaccggcgtctgggtcatagcccacgagggcggccaccacgccttcagcgactac

SEQ ID NO: 27639 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27640 - DNA, 370 bp, Artificial
  Mutation in BnaA.FAD2.a introduced by TALE nuclease pair BnFAD2_T03
caggatccatgggtgcaggtgggagaatgcaagtgtctcctccctccaagaagtctgaaaccgacaacatcaagcgcgtaccctgcgagacaccgcccttcactgtcggtgaacgctctcctgagtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27641 - DNA, 395 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactggtggccatcgccagcaatggcggtggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27642 - DNA, 450 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgagcgatcgttggcgtcggcaaacagtggtccggcgcacgcgctctggaggccttgctcacggtggtgggagagttgagaggtccaccgttacagttggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27643 - DNA, 349 bp, Artificial
  Mutation in BnaA.FAD2.a introduced by TALE nuclease pair BnFAD2_T03
caggatccatgggtgcatgtggaaggatgcaagtgtctcctccctccaaaaagtctgaaaccgacaacatcaagcgcgtaccctgcgagacaccgcccttcactttgaactcaagaaagcaatcccaccgcactgtttcaaacgctcgatccctcgctctttctcctacctcatctgggacatcatcatagcctcctgcttctcctccgtcgccaccacttacttccctctcctccctccccctctctcctacttcgcctggcccctctactgggcctgccagggctgcgtcctaaccggcgtctgggtcatagcccacgagtgcggccaccacgccttcagcgactcc

SEQ ID NO: 27644 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccagggctgcgtcctaaccggcgtctgggtcatagcccacgagtgcggccaccacgccttcagcgactac

SEQ ID NO: 27645 - DNA, 358 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggcggagaactcaagaaagcagtcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27646 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27647 - DNA, 397 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagcaggtggtggccatcgccagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgcctgggctgcgtcctaaccggcgtctgggtcatagcccacgagtgcggccaccacgccttcagcgactac

SEQ ID NO: 27648 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactatgtcgccaccacttacttccctctcctccctcaccctctctcctacttcgcctggcctctctactgggcctgccagggctgcgtcctaaccggcgtctgggtcatagcccacgagtgcgaccaccacgccttcagcgactac

SEQ ID NO: 27649 - DNA, 370 bp, Artificial
  Mutation in BnaA.FAD2.a introduced by TALE nuclease pair BnFAD2_T03
caggatccatgggtgcaggtggaagaatgcaagtgcctcctccctccaaaaagtctgaaaccgacaacatcaagcgcgtaccctgcgagacaccgcccttcactgtcggtgaacgctctcctgagtagaactcaagaaagcaatcccaccgcactgtttcaaacgctcgatccctcgctctttctcctacctcatctgggacatcatcatagcctgctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27650 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccctgcgagacaccgcccttcactgagaactcaagaaagcaatcccaccgcactgtttcaaacgctccatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27651 - DNA, 346 bp, Artificial
  Mutation in BnaA.FAD2.a introduced by TALE nuclease pair BnFAD2_T03
caggatccatgggtgcaggtggaagaatgcaagtgtcttctccctccaagaagtctgaaaccgacaccatcaagcgcgtaccctgcgagacaccgcccttcactacctcaagaaagcaatcccacctcactgcttcaaacgctcgatccctcgctctttctcctacctcatctgggacatcatcatagcctcctgcttctactacgtcgccaccacgtacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27652 - DNA, 432 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagcggctgttgccggtgctgtgccaggcccacggcttgaccccggagcaggggggggccatcgccagccacgatggcggtggagaactcaagaaagcaatcccaccgcactgtttcaaacgctcgatcccccgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27653 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcattatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27654 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctagcccctctactgggcctgccaaggcttcgtcctaacgggcctctgggtcatcgcccacgaatgcggccaccacgccttcagcgactac

SEQ ID NO: 27655 - DNA, 351 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27656 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggctcatagcccacgagtgcggccaccacgccttcagcgactac

SEQ ID NO: 27657 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtccgaaaccgacaccatcaagcgcgtaccctgcgagacaccgcccttcactgttagaactcaagaaagcaatcccaccgcactctttcaaacgctccatccctcgctctttctcctacctctcctgggacatcatcatatcctcctgcttctactacgtcgccaccacttacttccctctcctcccccaccctctctcctacttcgcctggcctctctactgggcctgccagggctgcgtcctaaccggcgtctgggtcatagcccacgaatgcggccaccacgccttcagcgactac

SEQ ID NO: 27658 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcataagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcatgccagggctgcgtcctaaccggcgtctgggtcatagcccacgagtgcggccaccacgccttcagcgactac

SEQ ID NO: 27659 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctaaaacgcgtcccctgcgagacaccacccttcactcagacctcaagaaagcaatccaaccgcactgtttcaaacgctcgatccctcgctctttctcctacctcatctgggacatcatcatagcctcctgcttctactacgtcgccaccacttacttccctctcctccctcaccctctctcctacttcgcctagcctctctactgggcctgccagggctgcgtcctaaccggcgtctgggtcatagcccacgagtgcggccaccacgccttcagcgactac

SEQ ID NO: 27660 - DNA, 463 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggtggcaagcaggcgctggagacggtccagcggctgtttgccaccaatattgctggcgatggccaccacctgctccggggtcaagccgtgggcctggcacagcaccggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27661 - DNA, 325 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggactgcgtcctaaccggcgtctgggtcatagcccacgagtgcggccaccacgccttcagcgactac

SEQ ID NO: 27662 - DNA, 389 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggtttgtttgccggatcaagagctaccaactctttttccgaagaactcaagaaagcaatcccaccgcactgtttcaaacgctcgatccctcgctctttctcctacctcatctgggacatcatcatagcctcctgcttctactacgtcgccaccacgtacgtccctctcctccctcacccgcgctcctgcttcgcctggcctctctacggggcctgccaagggtgcgtcctaaccggcgtctgggtcatagcccacgagtgcggccaccacgccatcagcgactac

SEQ ID NO: 27663 - DNA, 345 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27664 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttgcttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27665 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccttgcgagacaccgcccttcactgagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27666 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactgtcagaactcacaaaaaaaatcccaccgcactgtgtcacaaactcgctccctcgctctttctcctacctcatctgtcacatcatcataccctccttcttctactacgtcgccaccacttacttccctctcctccctcaccctctctccctctccgcccggcctctctactcggcctgccagggcggcgtcctaaccggcgtctgggtgagagcccccgagtgtggcgaccacgccctcagcgactac

SEQ ID NO: 27667 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctgctcccccaccctctcccttacctcgcctggcccctctactgggcctgccaaggctgcgtcctaacgggcctctgggtcatagcccacgagtgcggccaccacgccttcagcgactac

SEQ ID NO: 27668 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgcccccacttacttccctctcctccctcaccctccctccttcatcccctggcctctctactgggcctgccagggctgcgtcctaaccggcgtctgggtcatagcccacgagtacggccaccacgccttcagcgactac

SEQ ID NO: 27669 - DNA, 408 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggacttcgctgctacccaaggttgccgggtgacgcacaccgtggaaacggatgaaggagaactcaagaaagcaatcccaccgcactgtttcaaacgctcgatccctcgctccttctcctacctcatctgggacatcatcatagcctcctgcttctactacgtcgccaccacttacttccctctcccccctcaccctctctcctacttcgcctggcctctctactgggcctgccaagggtgcgtcctaacgggcctctgggtcatagcccacgagtgcggccaccacgccttcagcgactac

SEQ ID NO: 27670 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacgggccctgccaggcctgcgtcctaccgggcctctgggtcatccccaacaaatccggcccccccgccttcaccgactcc

SEQ ID NO: 27671 - DNA, 314 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagctactac

SEQ ID NO: 27672 - DNA, 479 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaatgtcattgcgctgccattctccaaattgcagttcgcgcttagctggataacgccacggcatgatgtcgtcgtgcacaacaatggtgacttctacagcgcggagaatctcgctctctccaggggaagccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27673 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27674 - DNA, 340 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaaacgcgtaccctgcgagacaccgcccttcactgaactcaagcaagaaatcccaccgcactgtttcaaacgctcaatccctcgctctttctcctacctctccttggacatcatcatagcctcctcggctcctccctctaccacctctccacatcctacttccctctcccttacctcgcctgacccctctactaggcctgccaaggctgcgtcctaacgggcctctgggtcatagcccacgagtgcggccaccgcgccttcagcgactac

SEQ ID NO: 27675 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 27676 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctacctcatctgtgacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27677 - DNA, 341 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 27678 - DNA, 406 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccgactgggcctttcgttttatctgttgtttgtcggtgaacgctctcctgagtaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27679 - DNA, 336 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27680 - DNA, 348 bp, Artificial
  Mutation in BnaA.FAD2.a introduced by TALE nuclease pair BnFAD2_T03
caggatccatgggtgcaggaggaagaatgcaagtctctcctccctccagctcccccgaaaccaaaaccctcaaacgcgtcccctgcgagacaccacccttcactcgacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27681 - DNA, 349 bp, Artificial
  Mutation in BnaA.FAD2.a introduced by TALE nuclease pair BnFAD2_T03
caggatctgggtgcaggtggaagaatgcaagtgtctcctccctccaaaaagtctgaaaccgacaacatcaagcgcgtaccctgcgagacaccgcccttcactgtgagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27682 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 27683 - DNA, 340 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccggagaacccaagaaagcaatcccaccgcactgtttcaaacgcccgatccctcgctctttctcctacctcatctggcacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27684 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 27685 - DNA, 351 bp, Artificial
  Mutation in BnaA.FAD2.a introduced by TALE nuclease pair BnFAD2_T03
caggatccatgggtgcaggtggaagaatgcaagtgtctcctacctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27686 - DNA, 383 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtaacgaccttttggaaacttcggcttcccctgaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27687 - DNA, 304 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27688 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgttccaaacgctcgatcccccgctctttctcctacctcatctcgcacatcatcatagcctcctgcttctactacgtcgccaccacttacttccctctcctccctcaccctctctcctacttcgcctggcccctctactgggcctgccaagggtgcgtcctaaccggcgtctgggtcatagcccacgagtgcggccaccacgccttcagcgactac

SEQ ID NO: 27689 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27690 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaagcaatcccaccgcactgtttcaaacgctcgatccctcgctctttctcctacctcatctgggacatcatcatagcctcctgcttctactacgtcgccacgacttacttccctctcctccctcaccctctctcctacttcgcctggcctctctactgggcctgccagggctgcgtcctaaccggcgtctgggtcatagcccacgagtgcggccaccacgccttcagcgacac

SEQ ID NO: 27691 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcagggctgcgtcctaaccggcgtctgggtcatagcccacgagtgcggccaccacgccttcagcgactac

SEQ ID NO: 27692 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcataacccacgagtgcggccaccacgccttcagcgactac

SEQ ID NO: 27693 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctctttctcctacctcatctgcgacatcatcatagcctcctgcttctactacggcgccaccacttacttccctctcctccctcaccctctctcctacttcgcctggcatctctacgggggctgccagggctgcgtcctaaccggcgtgtgggtcataggccacgagtgcggccaccacgccttcagcgactac

SEQ ID NO: 27694 - DNA, 344 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccaagagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27695 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaaccggcgtctgggtcatagcccacgagtgcggccaccacgccttcagcgactac

SEQ ID NO: 27696 - DNA, 347 bp, Artificial
  Mutation in BnaA.FAD2.a introduced by TALE nuclease pair BnFAD2_T03
caggatccatgggtgcaggtggaagaatgcaagcctctcctccctccagctcccccgaaaccaaaaccctcaaacgcgtcccctgcgagacaccacccttcactagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactacgccgggcctctctactgggcctgccagggctgcgtcctaaccggcgtctgggtcatagcccacgagtgcggccaccacgcctcagcgactac

SEQ ID NO: 27697 - DNA, 295 bp, Artificial
  Mutation in BnaA.FAD2.a introduced by TALE nuclease pair BnFAD2_T03
caggatccatgggtgcaggtgcaagaatgcaagtctctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27698 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctcccccaccctctcccttacctcgcctggcccctctactgggcctgccaaggctgcgtcctaaccggcgtctgggtcatatcccacgagtgcggccaccacgccttcagcgactac

SEQ ID NO: 27699 - DNA, 402 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27700 - DNA, 345 bp, Artificial
  Mutation in BnaA.FAD2.a introduced by TALE nuclease pair BnFAD2_T03
caggatccatgggtgcaggtggaagaatgcaagtgtctcctcactccaaaaagactgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27701 - DNA, 374 bp, Artificial
  Mutation in BnaA.FAD2.a introduced by TALE nuclease pair BnFAD2_T03
caggatccatgggtgcaggtggaagaatgcaagtgtctcctacctccaaaaagtctgaaaccgacaacatcaagcgcgtaccctgcgagacaccgcccttcactaactccagaaacccgcggctgagtggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgggcctgccagggctgcgtcctaaccggcgtctgggtcatagcccacgagtgcggccaccacgccttcagcgactac

SEQ ID NO: 27702 - DNA, 370 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccctcaagcgcgtaccctgcgagacaccgcccttcactggcaagcaggccctggagacggagaactcaagaaagcaatcccaccgcactgtttcaaacgctcgatccctcgctctttctcctacctcatctgggacatcatcataccctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27703 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27704 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 27705 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 27706 - DNA, 371 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctgggggtcaagttgagcggggcacccgtcagtgcattgcgccagagaactcaagaaagcaatcccaccgcactgtttcaaacgctcgatccctcgctctttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27707 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27708 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcgagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27709 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaaccttcggtttgatcttctcctgttgctcggctatgtgccagccactgctagacctcaagaaagcaatcccaccgcactgtttcaaacgctcgacccctcgctctttctcctacctcatctgggacatcatcatatccccccgcttctactacgccgccacctcctacctccctcccccccctcaccctctctcctacctcgcctggcctctctactgggcctgccaagggtgcgtcctaaccggcgtctgggtcatagcccacgagtgcggccaccacgccttcagcgactac

SEQ ID NO: 27710 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactaacctcaagaaagcaatcccaccgcactgtttcaaacgctcgatccctcgctctttctcctacctcatctgggacatcatcatagcctcctgcttctactacgtcgccaccgcttacttccctctcctccctcaccctctctcctacttcgcctggcctctctactgggcctgccagggctgcgtcctaaccggcgtctgggtcatggcccactggtgcggccaccacgccttcagccactac

SEQ ID NO: 27711 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27712 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctttactgggcctgccagggctgcgtcctaaccggcgtctgggtcatagcccacgagtgcggccaccacgccttcagcgactac

SEQ ID NO: 27713 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27714 - DNA, 419 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccgactgagcctttcgttttatctgttgtttgtcggtgaacgctctcctgagtaggacaaatccgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27715 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctggcctctctactgggcctgccagggctgcgtcctaaccggcgtctgggtcatagcccacgagtgcggccaccacgccttcagcgactac

SEQ ID NO: 27716 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaatccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27717 - DNA, 444 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgtgggcctggcacagcaccggcaacagcgcctgcaccgtctccagcgctggtttgccaccaatattgctggcgatggccaccacctgctacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27718 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27719 - DNA, 351 bp, Artificial
  Mutation in BnaA.FAD2.a introduced by TALE nuclease pair BnFAD2_T03
caggatccatgggtgcaggcggaagaatgcaagtgtctcctccctccaagaagtctgaaaccgacaacatcaagcgcgtaccctgcgagacaccgcgggcctggcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27720 - DNA, 316 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27721 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccggcctctctactgggcctgccagggctgcgtcctaaccggcgtctgggtcatagcccacgagtgcggccaccacgccttcagcgactac

SEQ ID NO: 27722 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27723 - DNA, 350 bp, Artificial
  Mutation in BnaA.FAD2.a introduced by TALE nuclease pair BnFAD2_T03
caggatccatgggtgcaggcggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccgcgccttcagcgactac

SEQ ID NO: 27724 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27725 - DNA, 408 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtcccctgcgagacaccactcaaatccgctcccggcggatttgtcctactcaggagagcgttcaccgacaaacaacagataaaacgaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27726 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccagggctgcgtcctaacgggcctctgggtcatcgcccacgaatgcggccaccacgccttcagcgactac

SEQ ID NO: 27727 - DNA, 479 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaatgtcattgcgctgccattctccaaattgcagttcgcgcttagctggataacgccacggaatgatgtcgtcgtgcacaacaatggtgacttctacagcgcggagaatctcgctctctccaggggaagccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27728 - DNA, 329 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27729 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27730 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 27731 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatcgcccacgaatgcggccaccacgccttcagcgactac

SEQ ID NO: 27732 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccatgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctactccctcaccctctctcctacttcgcctggcctctctactgggcctgccagggctgcgtcctaaccggcgtctgggtcatagcccacgagtgcggccaccacgccttcagcgactac

SEQ ID NO: 27733 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttaccgcgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27734 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27735 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactatttcaaacgctcgatccctcgctctttctcctacctcatctgggacatcatcatagcctcctgcttctactacgtcgccaccacttacttccctctcctccctcaccctctcctacttcgcctggcctctctactgggcctgccagggctgcgtcctaaccggcgtctgggtcatagcccacgagtgcggccaccacgccttcagcgactac

SEQ ID NO: 27736 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactgtcaagaaagcaatcccaccgcactgtttcaaacgctcgatccctcgctctttctcctacctcatctgggacatcatcacagcctcctgcttctactacgtcgccaccacttacttccctctcctccctcaccctctctcctacttcgcctggcctctctactgggcctgccagggctgcgtcctaaccggcgtctgggtcatagcccacgattgcggccaccacgccttcagcgactac

SEQ ID NO: 27737 - DNA, 323 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcacgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27738 - DNA, 433 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggtggcaagcatgcgctggagacggtccagcggctgtttccggtgctgtgcccggcccacggcttgaccccccagcaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 27739 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctccctcctacttcgcctggcctctctactgggcctgccagggctgcgtcctaaccggcgtctgggtcatagcccacgagtgcggccaccacgccttcagcgactac

SEQ ID NO: 27740 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27741 - DNA, 406 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggctggcgatggccaccacctgctggggggtcaagccgtgggcctggcacagcaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 27742 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctactacttcgcctggcctctctactgggcctgccagggctgcgtcctaaccggcgtctgggtcatagcccacgagtgcggccaccacgccttcagcgactac

SEQ ID NO: 27743 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactacttcgcctggcctctctactgggcctgccagggctgcgtcctaaccggcgtctgggtcatcgcccacgaatgcggccaccacgccttcagcgactac

SEQ ID NO: 27744 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgatttcggccaccacgccttcagcgactac

SEQ ID NO: 27745 - DNA, 304 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 27746 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27747 - DNA, 412 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttcaggagagcgttcaccgacaaacaacagataaaacgaaaggcccagtcttccgactgagccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27748 - DNA, 383 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacggtccagcggctgttgccggtgctgtgccaggcccacggcttgaccccggagcaggtggtggccagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27749 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27750 - DNA, 331 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27751 - DNA, 349 bp, Artificial
  Mutation in BnaA.FAD2.a introduced by TALE nuclease pair BnFAD2_T03
caggatccatgggtgcaggtgcaagaatgcaagtctctcctccctcccgctcccccgaaaccaaaaccctcaaacgcgtcccctgcgagacaccacccttcactcagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggggcatagcccacgagtgcggccaccacgccttcagcgactac

SEQ ID NO: 27752 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 27753 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27754 - DNA, 463 bp, Artificial
  Mutation in BnaA.FAD2.a introduced by TALE nuclease pair BnFAD2_T03
caggatccatgggtgcaggtggaataatgcaagtgtctcctccctccaaaaagtctgaaaccgacaacatcaagcgcgtaccctgcgagacaccgcccttcactgttgctgctggctggcttcagcagagcgcagataccaaatactgttcttctagtgtagccgtcgccagcccagtcgggcggcgagttccatagcgttaagtgcaacaaattgatgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 27755 - DNA, 348 bp, Artificial
  Mutation in BnaA.FAD2.a introduced by TALE nuclease pair BnFAD2_T03
caggatccatgggtgcaggtcgaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27756 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27757 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctcagcgactac

SEQ ID NO: 27758 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctcttcctcctacctcatctgggacatcatcatagcctcctgcttctactacgtcgccaccacttacttccctctcatccctcaccctctcccttacctcgcctggcccctctactgggcctgccaaggctgcgtcctaacgggcctctgggtcatcgcccacgaatgcggccaccacgccttcagcgactac

SEQ ID NO: 27759 - DNA, 395 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggcggccaccgccagcaatggcggcggcaagcaggctccggagacggagacctcaagaaagcaaccccaccgcactgtttcaaacgctcgacccctcgctccttctcctacctcacctgcgacatcatcatcgcctcctgcttctaccacgtcgccaccgcctacttccctcccctcccccaccctctctcctacttcgcctggcctctctactgggcctgccagggctgcgtcctaaccggcgtctgggtcatagcccacgagtgcggccaccacgccttcagcgactac

SEQ ID NO: 27760 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgccctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27761 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 27762 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaacgcctgaaaccgacaacatcaagcgcgtaccatgcgagaactcaagaaagcaatcccaccgcactgattcaaacgctcgacccctcgctctttctcctacctcatctgggacatcatcatagcctcctgcttctactacgtcgccaccgcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27763 - DNA, 402 bp, Artificial
  Mutation in BnaA.FAD2.a introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcactgtccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27764 - DNA, 347 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcttggccatagcccacgagtgcggccaccacgccttcagcgactac

SEQ ID NO: 27765 - DNA, 403 bp, Artificial
  Mutation in BnaA.FAD2.a introduced by TALE nuclease pair BnFAD2_T03
catgatccatgggtgcaggtggaagaatgcaagtgtctcctccctccaaaaagtctgaaaccgacaacatcaagcgcgtaccctgcgagacaccgcccttcactgtcgaaccttcggtgagagcttctcctgttgctcggctatgtgccaggccatgctagaactcaagaaagcaatcccaccgcactgtttcaaccgctcgatccctcgctctttctcctacctcatctgggacatcatcatagcctcctgcctctactactccgccccctcctacttcccccccctccctctccctctctcctacctcgcctggcctctctactgggcctgccaagggtgcgtcctaaccggcgtctgggtcatagcccacgagtgcggccaccacgccttcagcgactac

SEQ ID NO: 27766 - DNA, 375 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctcccccgcctgacccctctactgggcctgccaaggctgcgtcctaacgggcctctgggtcatagcccacgagtgcggccaccacgccttcaggactac

SEQ ID NO: 27767 - DNA, 318 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgatac

SEQ ID NO: 27768 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 27769 - DNA, 350 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27770 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctggcctctctactgggcctgccagggctgcgtcctaaccggcgtctgggtcatagcccacgagtgcggccaccacgccttcagcaactac

SEQ ID NO: 27771 - DNA, 390 bp, Artificial
  Mutation in BnaA.FAD2.a introduced by TALE nuclease pair BnFAD2_T03
caggatccatgggtgcaggtggaagaatgcaagtgtctcctcccccaagaagtctgaaaccgacaccctcaagagcggaccctgcgagacacccgcttcctcgctcactgactcgctgggctcggtcgttcggctgcggcgagcggggaactcaagaaagcaatcccaccgcaatgtttcaaacgcccgacccctagctcttcctcctacctcacctgggcactcatcatagccgcctgcttctactacgtcgcccccacttacttccctcccccccccccccctctctccttcttcgcctggcctctctactgggcctgccagggctgcgtcctaaccggcgtctgggtcatagcccacgagtgcggccaccacgccttcagcgactac

SEQ ID NO: 27772 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctggcctctctactgggcctgccagggctgcgtcctaaccggcgtctgggtcatagcccgcgagtgcggccaccacgccttcaacgactac

SEQ ID NO: 27773 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27774 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagccaacgagtgcggccaccacgccttcagcgactac

SEQ ID NO: 27775 - DNA, 344 bp, Artificial
  Mutation in BnaA.FAD2.a introduced by TALE nuclease pair BnFAD2_T03
caggatccatgggtgcaggtagaagaatgcaagtctctcctccctccagctcccccggaaccaacaccctcaaacgcgtcccctgcgagacaccaccaagagacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27776 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27777 - DNA, 384 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagactgagcctttcgttttatctgttgtttgtcggtgaacgctctcctgagtaggtcaaatccgctctgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27778 - DNA, 397 bp, Artificial
  Mutation in BnaA.FAD2.a introduced by TALE nuclease pair BnFAD2_T03
caggatccatgagtgcaggtgaaagaatgcaagtgtgtcctccctccaaaaagtctgaaaccgacaacatcaagcgcgtaccctgcgagacaccgcccttcactgagcaggtggtggccatcgccagccacgatggcggcaagcaggcgctggagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 27779 - DNA, 308 bp, Artificial
  Mutation in BnaA.FAD2.a introduced by TALE nuclease pair BnFAD2_T03
caggatccatgggtgcaggtggaagaatgcaagtttctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27780 - DNA, 463 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgctgctggctggcttcagcagagcgcagataccaaatactgttcttctagtgtagccgtcgccagcccagtcgggcggcgagttccatagcgttaagtgcaacaaattgatgagaactcaagaaagcaatcccaccgcactgtttcaaacgctcgatccctcgctctttctcctacctcagctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27781 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 27782 - DNA, 350 bp, Artificial
  Mutation in BnaA.FAD2.a introduced by TALE nuclease pair BnFAD2_T03
caggatccatgggtgcaggtggaagaatgcaagtgactcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27783 - DNA, 347 bp, Artificial
  Mutation in BnaA.FAD2.a introduced by TALE nuclease pair BnFAD2_T03
caggatccatgggtgcaggtggaagaatgcaagtgtttcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27784 - DNA, 411 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctctgatcagggcgagataactgggcaacaatgctctccagcgccggcctgccgccgccattgagacctcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27785 - DNA, 346 bp, Artificial
  Mutation in BnaA.FAD2.a introduced by TALE nuclease pair BnFAD2_T03
caggatccatgggtgcaggtggaagaatgcaagtgtctcctccctccaacaactctgaaaccgacaacatcaagcgcgtaccctgcgagacaccacccttcactgactcaagaaagcaaacccaccgcactgtttcaaacgctcgatccctcgctctttctcctacctcatctgtgacatcatcatagcctcctgcttctactacgtcgccactccttacttccctctcctccctcaccctctcccctacttcgcctggcccctctactgggcctgccagggctgcgtcctaaccggcgtctgggtcatagcccacgagtgcggccaccacgccttcagcgactac

SEQ ID NO: 27786 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27787 - DNA, 295 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27788 - DNA, 383 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaacgaccttttggaaacttcggcttcccctgaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 27789 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccgatctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27790 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 27791 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggcctccacgccttcagcgactac

SEQ ID NO: 27792 - DNA, 355 bp, Artificial
  Mutation in BnaA.FAD2.a introduced by TALE nuclease pair BnFAD2_T03
caggatccatgggtgcaggtggaagaatgcaagtctctcctccctccagctcccccggaaacaacaccctcaaacgcgtaccctgcgagacaccgcccttcactgtcggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 27793 - DNA, 324 bp, Artificial
  Mutation in BnaA.FAD2.a introduced by TALE nuclease pair BnFAD2_T03
caggatccatgggtgcaggtcgaagaatgcaagtctctcctccctccagctcccccgaaaccaaaaccctcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27794 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccacctcactgcttcaaacgctcgatccctcgctctttctcctaccacatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27795 - DNA, 407 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtggacaccaaggcctactccggcggctacaacctgcccatcggccaggccgacgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27796 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27797 - DNA, 373 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacactgccaggcatcaaactaagcagaaggccatccgtcaaacgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27798 - DNA, 410 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggttcagcctggtcagctgggccttgtagttgcccttgaagtggcctgacacgaacaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcatcgactac

SEQ ID NO: 27799 - DNA, 374 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactccagaaacccgcggctgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27800 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtttcaaacgcccgaaccctcgctcttcctcctacctcatctgggacatcaccatagcctcctgcttctactacgtcgccaccacttacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 27801 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27802 - DNA, 407 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtggacaccaaggcctactccggcggctacaacctgccaatcggccaggccgacgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27803 - DNA, 350 bp, Artificial
  Mutation in BnaA.FAD2.a introduced by TALE nuclease pair BnFAD2_T03
caggatccatgggtgcaggtgtaagaatgcaagtgtctcctccctccaaaaagtctgaaaccgacaacatcaagcgcgtaccctgcgagacaccaccattcactgtagaacacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccgcgccatcagcgactac

SEQ ID NO: 27804 - DNA, 308 bp, Artificial
  Mutation in BnaA.FAD2.a introduced by TALE nuclease pair BnFAD2_T03
caggatccatgggtgcaggtgcaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctggggcatagcccacgagtgcggccaccacgccttcagcgactac

SEQ ID NO: 27805 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27806 - DNA, 401 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgggccttgtagttgcccttgaagtggccggacacgaacaggaacttgaactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27807 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagccactac

SEQ ID NO: 27808 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgtgtcatagcccacgagtgcggccaccacgccttcagcgactac

SEQ ID NO: 27809 - DNA, 372 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggcggcaagcaggcgctggaggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27810 - DNA, 319 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcacgcgcgtaccctgcgagacaccgcccttcactgtttcaaacgctcgacccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27811 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27812 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccagggctgcgtcctaaccggcgtctgggtcatagcccacgagtgcggccaccacgccttcagcgactac

SEQ ID NO: 27813 - DNA, 351 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 27814 - DNA, 333 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaactctcgatccctcgccctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 27815 - DNA, 456 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtacaacctgctggggggtcaagccgtgggcctggcacagcaccggcaacagccgctggaccgtctccagcgcctgcttgccaccattattgctggcgatggccaccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27816 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttaaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27817 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27818 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 27819 - DNA, 344 bp, Artificial
  Mutation in BnaA.FAD2.a introduced by TALE nuclease pair BnFAD2_T03
caggatccatgggtgcaggtcgaagaatgcaagtgtctcctccctccaaaaagtctgaaaccgacaacatcaagcgcgtaccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27820 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 27821 - DNA, 346 bp, Artificial
  Mutation in BnaA.FAD2.a introduced by TALE nuclease pair BnFAD2_T03
cggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 27822 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcaagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27823 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 27824 - DNA, 349 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27825 - DNA, 380 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27826 - DNA, 347 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27827 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27828 - DNA, 308 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatcccacgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27829 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 27830 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27831 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27832 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgtgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccacaacgccttcagcgactac

SEQ ID NO: 27833 - DNA, 293 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 27834 - DNA, 348 bp, Artificial
  Mutation in BnaA.FAD2.a introduced by TALE nuclease pair BnFAD2_T03
caggacccatgggtgcaggtccaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27835 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacctcaaacgcgtaccctgcgagacaccgcccttcataagaactcaagaaaacaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27836 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 27837 - DNA, 280 bp, Artificial
  Mutation in BnaA.FAD2.a introduced by TALE nuclease pair BnFAD2_T03
caggatccatgggtgcaggtggaagaatgcaagtctcgacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 27838 - DNA, 326 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27839 - DNA, 346 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27840 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27841 - DNA, 348 bp, Artificial
  Mutation in BnaA.FAD2.a introduced by TALE nuclease pair BnFAD2_T03
caggatccatgggtgcaggtgaaagaatgcaagtctctcctccctccagctcccccggaaccaacaccctcaaacgcgtcccctgcgagacaccaccattcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactat

SEQ ID NO: 27842 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27843 - DNA, 333 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgtgtaccctgcgagacaccgcccttcactgtactcaagaaagcaatcccaccgcactgtttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 27844 - DNA, 368 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagcaatggcggtggctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27845 - DNA, 287 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27846 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcacagcctcctgcttctactacgtcgccaccacttacttccctctcctccctcaccctctctcctacttcgcctggcctctctactgggcctgccagggctgcgtcctaaccggcgtctgggtaatagcccacgagtgcggccaccacgccttcagcgactac

SEQ ID NO: 27847 - DNA, 351 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27848 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27849 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatatcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27850 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27851 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 27852 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctacttcgcctggcctctctactgggcctgccagggctgcgtcctaaccggcgtctgggtcatagcccacgagtgcggccacaacgccttcagcgactac

SEQ ID NO: 27853 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccaccgcacagtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27854 - DNA, 350 bp, Artificial
  Mutation in BnaA.FAD2.a introduced by TALE nuclease pair BnFAD2_T03
caggatccatgtgtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgattgcggccaccacgccttcagcgactac

SEQ ID NO: 27855 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccccttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27856 - DNA, 360 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27857 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctactacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27858 - DNA, 329 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27859 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctcttgctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27860 - DNA, 348 bp, Artificial
  Mutation in BnaA.FAD2.a introduced by TALE nuclease pair BnFAD2_T03
caggatccatgggtgcagctcgcagaatgcaagtgcctactccctccaagaagtctgaaaccgacaccatccagcgcgtaccctgcgagacaccgcccttcactgtaactcaagaaagccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggggcatagcccacgattgcggccaccacgccttcagcgactac

SEQ ID NO: 27861 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27862 - DNA, 350 bp, Artificial
  Mutation in BnaA.FAD2.a introduced by TALE nuclease pair BnFAD2_T03
catgatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27863 - DNA, 354 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27864 - DNA, 340 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacaccaagcgcgtaccctgcgagacaccgcccttcaccgaactcaagaaagcaatccaaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 27865 - DNA, 430 bp, Artificial
  Mutation in BnaA.FAD2.a introduced by TALE nuclease pair BnFAD2_T03
caggatccatgggtgcaggtggaagaatgcaagtgtatactccctccaaaaagtctgaaaccgacaacatcaaacgcgtaccctgcgaaacaccgcccttccatttggtacaccgccctacaccgcccttcacacgcccgccataaactgccaggcatcaaactaagcagaaggccatcctgacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27866 - DNA, 333 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctcttcgacatcatcatctcctcctcggctcctccctctaccacctctccacagcctacttccctctccattacctcgcctgacccctctactgggcctgccagggctgcgtcctaaccggcgtctgggtcatagcccacgagtgcggccaccacgccttcagcgactac

SEQ ID NO: 27867 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 27868 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactaacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27869 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctcgctcctacttcgcctggcctctctactgggcctgccaaggctgcgtcctaacgggcctctgggtcatagcccacgagtgcggccaccacgccttcagcgactac

SEQ ID NO: 27870 - DNA, 348 bp, Artificial
  Mutation in BnaA.FAD2.a introduced by TALE nuclease pair BnFAD2_T03
caggatccatgggtgcaggcggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 27871 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgcaaccacttacttccctctcctccctcaccctctctcctacttcgcctggcctctctactgggcctgccatggctgcgtcctaaccggcgtctgggtcatagcccacgagtgcggccaccacgccttcagcgactac

SEQ ID NO: 27872 - DNA, 344 bp, Artificial
  Mutation in BnaA.FAD2.a introduced by TALE nuclease pair BnFAD2_T03
caggatccatgggtgcaggtggaagaatgcaagtctctcctccctccagcccccccggaaccaacaccctcaaacgcgtcccctgcgagacaccgcccttcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27873 - DNA, 337 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggcccccccgccttcagcgactac

SEQ ID NO: 27874 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatggcccacgagtgcggccaccacgccttcagcgactac

SEQ ID NO: 27875 - DNA, 374 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttttgccagcgcctaatgcgccgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27876 - DNA, 350 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27877 - DNA, 339 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccatgcgagacaccgccctctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcggctgggtcatagcccacgagtgcggccaccacgccttcagcgactac

SEQ ID NO: 27878 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 27879 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcatcctaaccggcgtctgggtcatagcccacgagtgcggccaccacgccttcagcgactac

SEQ ID NO: 27880 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgaactcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27881 - DNA, 355 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 27882 - DNA, 348 bp, Artificial
  Mutation in BnaA.FAD2.a introduced by TALE nuclease pair BnFAD2_T03
caggatccatgggtgcaggtggaagaatgcaagtggctagaccctccaaaaagactgaaacagacaacatcaagggcgtaccgtgcgagacaccgcccttcactggaactcaagaaagcaatcccaccgcactgtttcaaacgcacgatccctcgctctttctcctacctcatctggcacatcatcatagcctcctgcttctactacgtcgccaccacttacttccctctcctccctcaccctctctccttcgtcgccaggcctctctacggtgcctgccaaggcggcgtcctaacggggctctgggtgatcgctcacgaatgaggccaccacgccttcagcgactac

SEQ ID NO: 27883 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatcgcccacgaatgcggccaccacgccttcagcgactac

SEQ ID NO: 27884 - DNA, 379 bp, Artificial
  Mutation in BnaA.FAD2.a introduced by TALE nuclease pair BnFAD2_T03
caggatccatgggtgcaggtgaaagaatgcaagtgtctcctccctccaaaaagtctgaaaccgacaacatcaagcgcgtaccctgcgagacacgcctgcttgccgccatcgtggctggcgatggccaccacctgctcctgtcacagcagagaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctcggggtcatagcccacgagtgctgcgaccacgccttcagcgactac

SEQ ID NO: 27885 - DNA, 325 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27886 - DNA, 348 bp, Artificial
  Mutation in BnaA.FAD2.a introduced by TALE nuclease pair BnFAD2_T03
caggatccatgggtgcaggtgtaagaatgcaagtgtctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27887 - DNA, 308 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27888 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccatcagcgactac

SEQ ID NO: 27889 - DNA, 347 bp, Artificial
  Mutation in BnaA.FAD2.a introduced by TALE nuclease pair BnFAD2_T03
caggatccatgggtgcaggtggaagaatgcaagtgtatactccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27890 - DNA, 350 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 27891 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 27892 - DNA, 343 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27893 - DNA, 280 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27894 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27895 - DNA, 347 bp, Artificial
  Mutation in BnaA.FAD2.a introduced by TALE nuclease pair BnFAD2_T03
caggatccatgggcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27896 - DNA, 397 bp, Artificial
  Mutation in BnaA.FAD2.a introduced by TALE nuclease pair BnFAD2_T03
caggatccatgggtgaggtggaagaatgcaagtgtctcctccctccaaaaagtctgaaaccgacaacatcaagcgcgtaccctgcgagacaccgcccttcactgtcgggcgactgccctgctgcgtaacatcgttgctgctccataacatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 27897 - DNA, 308 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27898 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctatccggcgtctgggtcatcgcccacgaatgcggccaccacgccttcagcgactac

SEQ ID NO: 27899 - DNA, 350 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27900 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaaacgcgtaccctgcgagacaccgcccttcactgtagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27901 - DNA, 319 bp, Artificial
  Mutation in BnaA.FAD2.a introduced by TALE nuclease pair BnFAD2_T03
caggatccatgggtgcaggtggaagaatgcaagtgtctcctccctcaaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27902 - DNA, 318 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27903 - DNA, 466 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtggtccagcgcctgcttgccgccatcgtggctggcgatggccaccacctgctccggggtcaagccgtgggcctggcacagcaccggcaacagccgctggaccgtctccagcgcctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27904 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccccctggcctctctactgggcctgccaagggtgcgtcctaaccggcgtctgggtcatagcccacgagtgcggccaccacgccttcagcgactac

SEQ ID NO: 27905 - DNA, 349 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacctcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27906 - DNA, 351 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctatttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27907 - DNA, 310 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagtgcgtaccctgcgagacaccgcccttcactgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27908 - DNA, 332 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 27909 - DNA, 309 bp, Artificial
  Mutation in BnaA.FAD2.a introduced by TALE nuclease pair BnFAD2_T03
caggatccatgggtgcaggtggcagaatgcaagtgtctcctccccccaaaaagtctgaaaccgacaacatcaaaccgacaacacccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27910 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatatcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27911 - DNA, 351 bp, Artificial
  Mutation in BnaA.FAD2.a introduced by TALE nuclease pair BnFAD2_T03
caggatccatgggtgcaggtggaagactgcaagtgtctcctccctccaagaagtctgaaaccgacaccatcaagcgcgtaccctgcgagacaccgcccctcactgtaagaactcaagaaagcaatcccaccgcactgtttcaaacgctcaatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 27912 - DNA, 466 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtggtccagcgcctgcttgccgccatcgtggctggcgatggccaccacctgctccggggtcaagccgtgggcctggcacagcaccggcaacagccgctggaccgtctccagcgcctggagaactcaagaaagcaatcccaccgcactgttccaaacgctcgatccctcgctctttctcctacctcatctgggacatcatcatagccccctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 27913 - DNA, 338 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27914 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcagtgtttcaaacgctcgctccctcgctctttctcctacctcatctgggacatcatcatagcctcctgcttctactacgtctccaccacttacttccctctcctccctcaccctctctcctacttcccctgccctctctcctgctcctcccagtgctgcttccttcccggcgtctgtctcatagcccacgagtgcggcaaccacgccttcagcgactac

SEQ ID NO: 27915 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 27916 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacctcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 27917 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27918 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctcccttaccctctctcctacttcgcctggcctctctactgggcctgccaagggtgcgtcctaaccggcgtctgggtcatagcccacgagtgcggccaccacgccttcagcgactac

SEQ ID NO: 27919 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 27920 - DNA, 348 bp, Artificial
  Mutation in BnaA.FAD2.a introduced by TALE nuclease pair BnFAD2_T03
caggatccatgggtgcaggtggaagaatgcaagtgactcctccctccaagaagtctgaaaccgacaacatcaagcgcgtaccctgcgagacaccgcccttcataagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27921 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaaggcggccaccacgccttcagcgactac

SEQ ID NO: 27922 - DNA, 384 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtctcctgcgagacaccacccttccccggagcaggtggtggccatcgccagcaatattggtggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27923 - DNA, 350 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcggcctaaccggcgtctgggtcatagcccacgagtgcggccaccacgccttcagcgactac

SEQ ID NO: 27924 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccggcctctctactgggcctgccagggctgcgtcctaaccggcgtctgggtcatagcccacgagtgcggccaccacgccttcagcgactac

SEQ ID NO: 27925 - DNA, 345 bp, Artificial
  Mutation in BnaA.FAD2.a introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27926 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtcccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27927 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcgggcctggcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgtctac

SEQ ID NO: 27928 - DNA, 414 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggggcggagcctatggaaaaacgccaggaaccgtaaaatatcaaccatagtacgcgccgctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27929 - DNA, 337 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 27930 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 27931 - DNA, 351 bp, Artificial
  Mutation in BnaA.FAD2.a introduced by TALE nuclease pair BnFAD2_T03
caggatccatgggtgcaggcggaagaatgcaagtgtctcctcaatccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcgtccaccacgccttcagcgactac

SEQ ID NO: 27932 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccggcctctctactgggcctgccaaggctgcgtcctaaccggcgtctgggtcatagcccacgagtgcggccaccacgccttcagcgactac

SEQ ID NO: 27933 - DNA, 346 bp, Artificial
  Mutation in BnaA.FAD2.a introduced by TALE nuclease pair BnFAD2_T03
caggatccatgggtgcaggtggaagaatgcaagtgtatcctcactccaagaagtctgaaaccgacaccatcaagcgcgtaccctgcgagacaccgcccttcactgtctcaagaaagcaatcccaccgcactgtttcaaacgctcgatccctcgctctttctcctacctcatctgggacatcatcatagcatcctgcttctactacgtcgccaccacttacttccctctcctccctcaccctctctcctacttcgcctggcctctctactgggcctgcccgggctgcgtcctaaccggcgtctgggtcatagcccacgagtgcggccaccacgccttcagcgactac

SEQ ID NO: 27934 - DNA, 341 bp, Artificial
  Mutation in BnaA.FAD2.a introduced by TALE nuclease pair BnFAD2_T03
caggatccatgggtgcaggtggcagaatgcaagtgtctcctcactccaagaagtctgaaaccgacaccatcaagcgcgtaccctgcgagacaccgcccttcactgtgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcccaaccggcgtctgggtcatagcccacgagtgcggccaccacgccttcagcgactac

SEQ ID NO: 27935 - DNA, 456 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggctgttgccggtgctgtgccaggcccacggcttgaccccggagcaggtggtggccatcgccagcaatattggtggcaagcaggcgctggagacggtgcaggagaactcaagaaagcaatcctaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatcgcccacgaatgcggccaccacgccttcagcgactac

SEQ ID NO: 27936 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27937 - DNA, 350 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27938 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27939 - DNA, 345 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 27940 - DNA, 341 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27941 - DNA, 434 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcccagcaggtggtggccatcgccagcaatggcggtggcaagcaggcgctggagacggtccagcggctgttgccggtgctgtgccagaactcaagaaagcaatcccaccgcactgtttcaaacgctcgatccctcgctctttctcctacctcagctgggacatcatcatagcctcctgcttctactacgtcgccaccacttacttccctctccgccctcaccctcgcccttacctcgcctggcccctctactgggcctgccaaggctgcggcctaacgggcctctgggtcatagcccacgagtgcggccaccacgccttcagcgactac

SEQ ID NO: 27942 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgaatgcggccaccacgccttcagcgactac

SEQ ID NO: 27943 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttgcctctctactgggcctgccagggctgcgtcctaaccggcgtctgggtcatagcccacgagtgcggccaccacgccttcagcgactac

SEQ ID NO: 27944 - DNA, 415 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcccacggcttgaccccggagcaggtggtggccatcgccagccacgatggcggcaacagccgctggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27945 - DNA, 331 bp, Artificial
  Mutation in BnaA.FAD2.a introduced by TALE nuclease pair BnFAD2_T03
caggatccattggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 27946 - DNA, 295 bp, Artificial
  Mutation in BnaA.FAD2.a introduced by TALE nuclease pair BnFAD2_T03
catgatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctagcgggcctctgggtcatcgcccacgaatgcggccaccacgccttcagcgactac

SEQ ID NO: 27947 - DNA, 410 bp, Artificial
  Mutation in BnaA.FAD2.a introduced by TALE nuclease pair BnFAD2_T03
caggatccatgggtgcaggtggaagaatgcaagtctctcctacctccagctcctctgaaaccaacaccctcaaacgcgtcccctgcgagacaccacccttcactctcggaagacttagtccactacgcgcaccgcctggtttagcaccggcgatcgccgctggtcgagacctcaagaaagcaatcccaccgcactgtttcaaacgctcgatccctcgctctttctcctacctcatctgggacatcatcatagcctcctgcttctactacgtagccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27948 - DNA, 351 bp, Artificial
  Mutation in BnaA.FAD2.a introduced by TALE nuclease pair BnFAD2_T03
caggatccatgggtgcaggtggcagaatgcaagtgtctaccccctcaaaaaagtctgaaaccgacaccataaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctgaccggcgtctgggtcatagcccacgagtgcggcgaccacgccttcagcgactac

SEQ ID NO: 27949 - DNA, 331 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27950 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacggttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27951 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27952 - DNA, 347 bp, Artificial
  Mutation in BnaA.FAD2.a introduced by TALE nuclease pair BnFAD2_T03
caggatccatgggtgcaggtggaagaatgcatgtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27953 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgcttccaaccctcgatccctcgccctttccccttcctcatctcggccatcatcataacctcctgcttctactacggcgccacctctcacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27954 - DNA, 331 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 27955 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctacgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27956 - DNA, 349 bp, Artificial
  Mutation in BnaA.FAD2.a introduced by TALE nuclease pair BnFAD2_T03
caggatccatgggtgcaggtggaagaatgcaagtgcctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27957 - DNA, 337 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtgagaactcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 27958 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 27959 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgagaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27960 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagtccacgagtgcggccaccacgccttcagcgactac

SEQ ID NO: 27961 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagacaccaaacccaccgcactgttccaaacgctcgatccctcgctctttcccctacctcatctgtgacatcatcatagcctcctgcttctactacgtcgccaccgcttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 27962 - DNA, 350 bp, Artificial
  Mutation in BnaA.FAD2.a introduced by TALE nuclease pair BnFAD2_T03
caggatccatgggtgcaggtgtaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcccctggcctctctactgggcctgccggggctgcgtcctacccggcgtctgggtcatagcccacgattgcggccaccacgccttcagcgactac

SEQ ID NO: 27963 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactttagaactcaagaaagcaatcccaccgcactgtttcaaacgctcgacccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27964 - DNA, 314 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27965 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaaaaccctcaaacgcgtcccctgcgagacaccacccttcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27966 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaaccggatcaaagagttcctccgccgctggacctaccaaggcaacgctatgctctaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 27967 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcctcttcgacatcctcgtctcctcatccctctaccacctctccacagcctacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 27968 - DNA, 324 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27969 - DNA, 331 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcataagaactcaagaaagcaatcccaccgcactgtttcaaacgctcgatccctcgctctttctcctcgacatcatcatctcctcctcggctcctccctctaccacctctccacagcctacttccctctcccttacctcgcctggcccctctactgggcctgccaaggctgcgtcctaacgggcctctgggtcatcgcccacgaatgcggccaccacgccttcagcgactac

SEQ ID NO: 27970 - DNA, 325 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtatagcactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27971 - DNA, 304 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcaatcccaccgcactgtttcaaacgctcgatccctcgctctttctcctgcctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27972 - DNA, 350 bp, Artificial
  Mutation in BnaA.FAD2.a introduced by TALE nuclease pair BnFAD2_T03
caggatccatgggtgcaggtggaagaatgcaagtctatactccctccagctcccccgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccgcaccctctctcctacgacgcctggcctctcaacagggcctgccggggcagcgtcctaaccggagtctggggcatagcccacgagtgcggccaccacgcctgcaccgactac

SEQ ID NO: 27973 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgccctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27974 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcgccctctctcctacttcgcctggcctctctactgggcctgccagggctgcgtcctaaccggcgtctgggtcatagcccacgagtgcggccaccacgccttcagcgactac

SEQ ID NO: 27975 - DNA, 350 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 27976 - DNA, 385 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgggtcagggtgccggccttgatcatctcgccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27977 - DNA, 295 bp, Artificial
  Mutation in BnaA.FAD2.a introduced by TALE nuclease pair BnFAD2_T03
caggatccatgggtgcaggtggaagaatgcaagtgtctacaccccccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27978 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaacgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccagggctgcgtcctaaccggcgtctgggtcatagcccacgagtgcggccaccacgccttcagcgactac

SEQ ID NO: 27979 - DNA, 406 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctctccagcgcctgcttgccaccattattgctggcgatggccaccacctgctggggggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27980 - DNA, 351 bp, Artificial
  Mutation in BnaA.FAD2.a introduced by TALE nuclease pair BnFAD2_T03
caggatccatgggtgcaggtggaaaaatgcaagtgtctcctccctccaaaaagtctgaaaccgacaacatcaagcgcgtaccctgcgagacaccgcgggcctggcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 27981 - DNA, 391 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtacggtccagcggctgttgccggtgctgtgccaggcccacggagaactcaagaaagcaatcccaccgcactgtttcaaacgctcgatccctcgctctttctcctacctcatctgggacatcatcatagcctcctgcttctactacgtcgccaccacttacttccctcgcctccctcaccctctctcctacttcgcctggcctctctactgggcctgccagggctgcgtcctaaccggcgtctgggtcatagcccacgagtgcggccaccacgccttcagcgactac

SEQ ID NO: 27982 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcaactgggacatcatcatagcctcctgcttctactacgtcgccaccacttacttccctctcctccctcaccctctctcctactgcgcctggcctctctactgggcctgccagggctgcgtcctaaccggcgtctgggtcatagcccacgagtgcggccaccacgccatcagcgactac

SEQ ID NO: 27983 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccactagtgcggccaccacgccttcagcgactac

SEQ ID NO: 27984 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 27985 - DNA, 319 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 27986 - DNA, 344 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgggaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27987 - DNA, 355 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27988 - DNA, 349 bp, Artificial
  Mutation in BnaA.FAD2.a introduced by TALE nuclease pair BnFAD2_T03
caggatccacgggtgcaggtggaagaatgcaagtctctcctccctccagctcccccgaaaccaaaaccctcaaacgcgtcccatgcgagacaccaccattcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27989 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaatcgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttactttcctctcctccctcaccctctctcctacttcgcctggcctctctactgggcctgccagggctgcgtcctaaccggcgtctgggtcatagcccacgagtgcggccaccacgccttcagcgactac

SEQ ID NO: 27990 - DNA, 360 bp, Artificial
  Mutation in BnaA.FAD2.a introduced by TALE nuclease pair BnFAD2_T03
caggatccatgggtgcaggtggaagaatgcaagtgtatcctcactccaaaaagtctgaaaccgacaacatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27991 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccaagggtgcgtcctaaccggcgtctgggtcatagcccacgagtgcggccaccacgccatcagcgactac

SEQ ID NO: 27992 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27993 - DNA, 343 bp, Artificial
  Mutation in BnaA.FAD2.a introduced by TALE nuclease pair BnFAD2_T03
caggatccatgggtgcaggtggaagaatccaagtgtgtactcccaccaagaagtctgaaaaagacaccatcaagcgcgtaccctgcgagacaccgcccttcactgtaagaaagcaatcccacctcactgcttcaaacgctccatccctcgctctttctactacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggcgaccgcgccttcagcgactac

SEQ ID NO: 27994 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctgtcctacttcgcctggcctctctactgggcctgccagggctgcgtcctaaccggcgtctgggtcatagcccacgagtgcggccaccacgccttcagcgactac

SEQ ID NO: 27995 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27996 - DNA, 399 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttgggggatcctatcagccgttcccagctggtgaagtccgagctggaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 27997 - DNA, 343 bp, Artificial
  Mutation in BnaA.FAD2.a introduced by TALE nuclease pair BnFAD2_T03
caggatccatgggtgcagggggaagaatgcaagtgtctcctccctccaaaaagtctgaaaccgacaaaatcaagcgcgtaccctgcgagacaccgcccttcactgtagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagggcggccaccacgccttcagcgactac

SEQ ID NO: 27998 - DNA, 350 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 27999 - DNA, 352 bp, Artificial
  Mutation in BnaA.FAD2.a introduced by TALE nuclease pair BnFAD2_T03
caggatccatgggtgcaggcggaagaatgcaagtgtctcctccctccaaaaagtctgaaaccgacaacatcaagcgcgtaccctgcgagacaccgccattcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28000 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 28001 - DNA, 323 bp, Artificial
  Mutation in BnaA.FAD2.a introduced by TALE nuclease pair BnFAD2_T03
caggatccatgggtgcaggtggcagaatgcaagtgtatcctccctccaaaaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28002 - DNA, 308 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28003 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcggaccctcgctctttctcctacctcatctgggacctcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28004 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28005 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcaccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28006 - DNA, 293 bp, Artificial
  Mutation in BnaA.FAD2.a introduced by TALE nuclease pair BnFAD2_T03
caggatccatggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcacgactac

SEQ ID NO: 28007 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28008 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctggcctctctactgggcctgccagggctgcgtcctaacgggcctctgggtcatagcccacgagtgcggccaccacgccttcagcgactac

SEQ ID NO: 28009 - DNA, 359 bp, Artificial
  Mutation in BnaA.FAD2.a introduced by TALE nuclease pair BnFAD2_T03
caggatccagggtgcaggtggaagaatgcaagtgtctcctccctccaaaaagtctgaaaccgacaacatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 28010 - DNA, 349 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggtcctgccagggctgcgtcctaaccgggggctgggtcatagcccacgagtgcggccaccacgccatcagcgactac

SEQ ID NO: 28011 - DNA, 351 bp, Artificial
  Mutation in BnaA.FAD2.a introduced by TALE nuclease pair BnFAD2_T03
caggatccatgggtgcaggaggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28012 - DNA, 351 bp, Artificial
  Mutation in BnaA.FAD2.a introduced by TALE nuclease pair BnFAD2_T03
caggatccatgggtgcaggcggaagaatgcaagtgtctcctccctccaaaaagtctgaaaccgacaacaccaagcgcgtaccctgcgagacaccgcccttcactgttagaactcaagaaagcaatcccaccgcactgtttcaaacgctcgttccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28013 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctccaaaaacacacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28014 - DNA, 357 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 28015 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaggtacctcgcgaatgcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28016 - DNA, 347 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28017 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcacttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctacttcgcctggcctctctactgggcctgccagggctgcgtcctaaccggcgtctgggtcatagcccacgagtgcggccaccacgccttcagcgactac

SEQ ID NO: 28018 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccaaggctgcgtcctaacgggcctctgggtcatcgcccacgaatgcggccaccacgccttcagcgactac

SEQ ID NO: 28019 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaaccggatcaaagagttcctccgccgctggacctaccaaggcaacgctatgttctaactcaagaaagcaatcccaccgcactgtttcaaacgctcgatccctcgctctttctcctacctcatctgggacatcatcatagcctcctgcttctactacgtcgccaccacttacttccctcgcctccctccccctctctcctactccgcctggcctctctactgggcctgccaagggtgcgtcctaaccggcgtctgggtcatagcccacgatggcgtccaccaggccctcagcgactac

SEQ ID NO: 28020 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28021 - DNA, 280 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 28022 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28023 - DNA, 350 bp, Artificial
  Mutation in BnaA.FAD2.a introduced by TALE nuclease pair BnFAD2_T03
caggatccatgggtgcaggtggcagaatgcaagtgtctcctcactccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaaccggcgtctgggtcatagcccacgagtgcggccaccacgccttcagcgactac

SEQ ID NO: 28024 - DNA, 468 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtcggattgcaaaacgtggcggcgtgaccgcagtggaggcagtgcatgcatggcgcaatgcactgacgggtgccccgctcaacttgaccccccagcaggtggtggccatcgccagcacggagaactcaagaaagcaatcccaccgcactgtttcaaacgctcgatccctcgctctttctcctacctcatctgggacatcatcatagcctccggcttctactacgtcgccaccacttactgcccgctcctccctcaccctctctcctacttcgcctggcctctctactgggcctgccagggctgcgtcctaacgggcctctgggtcatagcccacgagtgcggccaccacgcctgcagcgactac

SEQ ID NO: 28025 - DNA, 340 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgtcctactcaagaaagcactcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactaa

SEQ ID NO: 28026 - DNA, 349 bp, Artificial
  Mutation in BnaA.FAD2.a introduced by TALE nuclease pair BnFAD2_T03
caggatccatgggtgcaggtggcagaatgcaagtgtctcctccctccaaaaagtcataaaccgacaacatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 28027 - DNA, 428 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtgctgtgccaggcccacggcttgaccccccagcaggtggtggccatcgccagcaataatggcggcaagcaggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28028 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28029 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttactcccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28030 - DNA, 280 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28031 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28032 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcgcgactac

SEQ ID NO: 28033 - DNA, 380 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtatcgacaaataatgattttattttgactgatagtgacctgttggagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 28034 - DNA, 342 bp, Artificial
  Mutation in BnaA.FAD2.a introduced by TALE nuclease pair BnFAD2_T03
caggatccatgggtgcaggtggaagaatgcaagtgtcttctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28035 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacttggcctgccagggctgcgtcctaaccggcgtctgggtcatagcccacgagtgcggccaccacgccttcagcgactac

SEQ ID NO: 28036 - DNA, 271 bp, Artificial
  Mutation in BnaA.FAD2.a introduced by TALE nuclease pair BnFAD2_T03
caggatccatgggtgcaggtggaagaatgcaagtgtctcctccctcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28037 - DNA, 419 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtcggcccacggcttgaccccccagcaggtggtggccatcgccagcaataatggtggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28038 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccagggctgcgtcctaacgggcctctgggtcatagcccacgagtgcggccaccacgccttcagcgactac

SEQ ID NO: 28039 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaaccctgaaaccgacaacatcaagcgcgtaccctgcgagacaccacccttaactcaagaaagcaaccccaccgcactgcttcaaacgctcttcccctccctctttcccctacctctcctctgtcatcatcataccctcctgcttctactactccgccaccacttacttcccgctcctccctcaccctctctcctacttcccctggcctctctactgggcctgccagggctgcgtcctaaccggcgtctgggtcatagcccacgagtgcggccaccacgccttcagcgactac

SEQ ID NO: 28040 - DNA, 333 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28041 - DNA, 338 bp, Artificial
  Mutation in BnaA.FAD2.a introduced by TALE nuclease pair BnFAD2_T03
caggatccatgggtgcaggtggaagaatgcaagtctctcctccctcaagctcccccggaaccaacaccctcaaacgcgtcccctgcgagacaccaccattcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28042 - DNA, 318 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 28043 - DNA, 345 bp, Artificial
  Mutation in BnaA.FAD2.a introduced by TALE nuclease pair BnFAD2_T03
caggatccatgggtgcaggtggaagaatgcaagtgtctcctcacttcaaaaagtctgaaaccgacaacatcaagcgcgtaccctgcgagccaccgccctttagaactcaagaaagcaatcccaccgcactgtttcaaacgctcgatccctcgctcttactcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccatcagcgactac

SEQ ID NO: 28044 - DNA, 347 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 28045 - DNA, 351 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctccagcgactac

SEQ ID NO: 28046 - DNA, 295 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccatcacgccttcagcgactac

SEQ ID NO: 28047 - DNA, 334 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 28048 - DNA, 402 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacgcgtacccataaccgctcaacttgaccccggagcaggtggtggccaccgccatggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28049 - DNA, 347 bp, Artificial
  Mutation in BnaA.FAD2.a introduced by TALE nuclease pair BnFAD2_T03
caggatccatgggtgcaggtggcagaatgcaagtctctcctccctcaagctcccccgaaaccaaaaccctcaaacgcgtcccctgcgagacaccacccttcactcacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28050 - DNA, 347 bp, Artificial
  Mutation in BnaA.FAD2.a introduced by TALE nuclease pair BnFAD2_T03
caggatccatgggtgcaggtggaagaatgcaagtgtctactcactcccaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28051 - DNA, 338 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 28052 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaagcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcatcgactac

SEQ ID NO: 28053 - DNA, 338 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28054 - DNA, 277 bp, Artificial
  Mutation in BnaA.FAD2.a introduced by TALE nuclease pair BnFAD2_T03
caggatccatgggtgcaggtgcaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28055 - DNA, 425 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgctttccagtcgggaaacctgtcgtgccagctgcattaatgaatcggccaacgcgcggggagaggcggtttgcatgaactcaagaaagcaatcccaccgcactgtttccaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28056 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcataagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 28057 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggggcatagcccacgagtgcggccaccacgccttcagcgactac

SEQ ID NO: 28058 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccgtcagcgactac

SEQ ID NO: 28059 - DNA, 325 bp, Artificial
  Mutation in BnaA.FAD2.a introduced by TALE nuclease pair BnFAD2_T03
caggatccatgggtgcaggtggaagaatgcaagtctctcctccctccaagaagcctgaaaccgacaccatcaagcgcgtaccctgcgagacaccgcccttcactgtcactgtttcaaacgctcgatccctcgctctttctcctacctcatctgggacatcatcatagcctcctgcttctactacgtcgccaccacttacctccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28060 - DNA, 351 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28061 - DNA, 403 bp, Artificial
  Mutation in BnaA.FAD2.a introduced by TALE nuclease pair BnFAD2_T03
caggatccatgggtgcaggtggaagaatgcaagtgtctcctccctcccaaaagtctgaaaccgacaacatcaagcgcgtaccctgcgagacaccgcccttcactgttaggcacctcgcgaatgcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28062 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccacctcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28063 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaatggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28064 - DNA, 408 bp, Artificial
  Mutation in BnaA.FAD2.a introduced by TALE nuclease pair BnFAD2_T03
caggatccatgggtgcaggtggaagaatgcaagtgtctcctccctccaaaaagtctgaacccgacaacatcaagcgcgtaccctgcgagacaccgcccttcactgtcggggtcaagccgtgggcctggcacagcaccggcaacagccgctggaccgtctccaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28065 - DNA, 346 bp, Artificial
  Mutation in BnaA.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 28066 - DNA, 342 bp, Artificial
  Mutation in BnaA.FAD2.a introduced by TALE nuclease pair BnFAD2_T03
caggatccatgggtgcaggtggaagaatgcaagtgtctcctccctcccaaaagtctgaaaccgacaccatcaagcgcgtaccctgcgagacaccgcccttcactgtcggcggagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccccctactgggcctgccaaggctgcgtcctaacgggcctctgggtcatagcccacgagggcggccaccacgcctgcagcgactac

SEQ ID NO: 28067 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 28068 - DNA, 351 bp, Artificial
  Mutation in BnaA.FAD2.a introduced by TALE nuclease pair BnFAD2_T03
caggatccatggggtgcaggtgaaagaatgcaagggtctcctccctccaaaaagtctgacaccgacaacatcaagcgcgtaccctgcgagataccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 28069 - DNA, 351 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28070 - DNA, 337 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctccatcccacgctccttctcctcttcgacatcatcatctcctcctcggctcctccctctaccacctctccacagcctacttccctctcccttacctcgcctggcctctctactgggcctgccagggctgcgtcctaaccggcgtctgggtcatagcccacgagtgcggccaccacgccttcagcgactac

SEQ ID NO: 28071 - DNA, 331 bp, Artificial
  Mutation in BnaA.FAD2.a introduced by TALE nuclease pair BnFAD2_T03
caggatccatgggtgcaggtgccagaatgcaagtttctcctccctcaagctcccccgaaaccaaaaccctcaaacgcgtcccctgcgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28072 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28073 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgtgcctgccaaggctgcgtcctaacgggcctctgggtcatcgcccacgaatgcggccaccacgccttcagcgactac

SEQ ID NO: 28074 - DNA, 318 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28075 - DNA, 414 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctaaaaaagcattgctcatcaatttgttgcaacgaacaggtcactatcagtcaaaataaaatcattatttctgagaactcaagaaagcaatcccaccgcactgtttcaaacgctcgatccctcgctctttctcctacctcatctgggacatcatcatagcctcctgcttctcctacgtcgccaccacttacttccctctcctccctcaccctctctcctacttcgcctggcctctctactgggcctgccaaggctgcgtcctaacgtgcctctgggtcatagcccacgagtgcggccaccacgccttcagcgactac

SEQ ID NO: 28076 - DNA, 349 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28077 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 28078 - DNA, 348 bp, Artificial
  Mutation in BnaA.FAD2.a introduced by TALE nuclease pair BnFAD2_T03
caggatccatgggtgcaggtggcagaatgcaagtctatcctccctccagctcccccggaaccaacaccctcaaacgcgtcccctacgagacaccaccattcactctacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagctactac

SEQ ID NO: 28079 - DNA, 382 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagcgccatctcgaaccgacgttgctggccgagacctcaagaaagcaatcccaccgcactgtttcaaacgctcgatccctcgctctttctcctacctcatctgcgacatcatcatagcctcctgcttctactacgtcgccccctcttactaccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28080 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28081 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgtccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28082 - DNA, 351 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28083 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagtagcctgaaaccgacaccatcaagcgcgtcccctgcgagacaccgcccttcactgtagaactcaagaaagcaatcccaccgcacggtttcaaacgctcgatccctcgctctttctcctacctcatctgggacctcatcctagcctcctgcttctcctacgtcgccaccgcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28084 - DNA, 406 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccgactgggcctttcgttttatctgttgtttgtcggtgaacgctctcctgagtaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28085 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28086 - DNA, 347 bp, Artificial
  Mutation in BnaA.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagccaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgcgcctgccagggctgcgtcctaaccggcgtctgggtcatagcccacgagtgcggccaccacgccagcagcgactac

SEQ ID NO: 28087 - DNA, 350 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccacccttcactgttgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28088 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28089 - DNA, 313 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtcccctgcgagacaccaccattcactgagacctaaagaaagcaatcccacctcactgcctcaaacgcaccatcccacgctccttctcctcttcgacatcctcatctactcctccgctcctccctcaccctctctcctacttcgcctggcctctctactgggcctgccaagggtgcgtcctaaccggcgtctgggtcatagcccacgagtgcggccaccacgccttcagcgactac

SEQ ID NO: 28090 - DNA, 358 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtcggggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28091 - DNA, 333 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgagcccccgatttagagcttgacggggagaactcaagaaagcaatcccaccgcactgcttcaaacgctcgatccctggctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatcgcccacgaatgcggccaccacgccttcagcgactac

SEQ ID NO: 28092 - DNA, 277 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagggcggccaccacgcctccaccgactac

SEQ ID NO: 28093 - DNA, 351 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28094 - DNA, 391 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggtccagcggctgttgccggtgctgtgccaggcccacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28095 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcctctctactgggcctgccaagggtgcgtcctaaccggcgtctgggtcatagcccacgagtgcggccaccacgccttcagcgactac

SEQ ID NO: 28096 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 28097 - DNA, 343 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctactacttcgcctggcctctctactgggcctgccagggctgcgtcctaaccggcgtctgggtcatagcccacgagtgcggccaccacgccttcagcgactac

SEQ ID NO: 28098 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagactgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaaccggcgtctgggtcatagcccacgagtgcggccaccacgccttcagcgactac

SEQ ID NO: 28099 - DNA, 343 bp, Artificial
  Mutation in BnaA.FAD2.a introduced by TALE nuclease pair BnFAD2_T03
caggatccatgggtgcaggtggaagaatgcaagtgtctccttcctccaaaaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28100 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaaccggcgtctgggtcatagcccacgagtgcggccaccacgccttcagcgactac

SEQ ID NO: 28101 - DNA, 403 bp, Artificial
  Mutation in BnaA.FAD2.a introduced by TALE nuclease pair BnFAD2_T03
caggatccatgggtgcaggtggcagaatgcaagtctctactccctccaaaaagtctgaaaccgacaacatcaagcgcgtaccctgcgagacaccgcccttcactgtcgaaccttcggtttgatcttctcctgttgctcggctatgtgccaggccatgctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatggctgcgtcctaacgggcctctgggtcatagcccacgagtgcggccaccacgccttcagcgactac

SEQ ID NO: 28102 - DNA, 349 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28103 - DNA, 370 bp, Artificial
  Mutation in BnaA.FAD2.a introduced by TALE nuclease pair BnFAD2_T03
caggatccatgggtgcaggtggaagaatgcaagtgtctcgtccctccaaaaagtctgaaaccgacaacatcaagcgcgtaccctgcgagacaccgcccttcactgtcggtgaacgctctcctgagtagaactcaagaaagcaatcccaccgcactgtttcaaacgctcgatccctcgctctttctcctacctcatctgggacatcatcatagcctcctgcttctactacgtcgccaccacttacttccctctcccccctcaccctctctcctacttcgcctggcctctctactgggcctgccaagggtgcgtcctaaccggcgtctgggtcatagcccacgagtgcggccaccacgccttcagcgactac

SEQ ID NO: 28104 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28105 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 28106 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtcggaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28107 - DNA, 394 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgccggtgctgtgccaggcccacggcttgaccccccagcaggtggtgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatcgcccacgaatgcggccaccacgccttcagcgactac

SEQ ID NO: 28108 - DNA, 333 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28109 - DNA, 373 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacactgccaggcatcaaactaagcagaaggccatccgtcaaacgctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28110 - DNA, 349 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcacgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28111 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28112 - DNA, 393 bp, Artificial
  Mutation in BnaA.FAD2.a introduced by TALE nuclease pair BnFAD2_T03
caggatccatgggtgcaggtggaagaatgcaagtgactcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28113 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28114 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcagggctgcgtcctaaccggcgtctgggtcatagcccacgagtgcggccaccacgccttcagcgactac

SEQ ID NO: 28115 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcttggtcatagcccacgagtgcggccaccacgccttcagcgactac

SEQ ID NO: 28116 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctcttcctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28117 - DNA, 350 bp, Artificial
  Mutation in BnaA.FAD2.a introduced by TALE nuclease pair BnFAD2_T03
caggatccatgggtgcaggtggaagaatgcaagtgtctactcacttccaaaagtctgaaaccgacaaaatcaagcgcgtaccctgcgagacaacgcccttcactgtagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggtctctctactgcgcctgccagtgctgcgtcctaaccggcttcttgttcatagcccacgagtgcggccaccacgccatcagcgactac

SEQ ID NO: 28118 - DNA, 410 bp, Artificial
  Mutation in BnaA.FAD2.a introduced by TALE nuclease pair BnFAD2_T03
caggatccatgggtgcaggtggcagaatgcaagtctctcctccctccaagaagtctgaaaccgacaccatcaagcgcgtaccctgcgagacaccgcccttcactgtcggttcagcctggtcagctgggccttgtagttgcccttgaagtggcctgacacgaacaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28119 - DNA, 376 bp, Artificial
  Mutation in BnaA.FAD2.a introduced by TALE nuclease pair BnFAD2_T03
caggatccatgggtgcaggtggcagaatgcaagtttctcctccctccaagaagtctgaaaccgacaccatcaagcgcgtaccctgcgagacaccgcccttcactgtcggttacgtgccccacgagtacatcgagctgctcgagatcgcccggaacagcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggtgatagcccacgagtgcggccaccacgccttcagcgactac

SEQ ID NO: 28120 - DNA, 383 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaagcgcggcgggtgtggggggtacgcgcataagtgaagggcggtgtaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28121 - DNA, 325 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 28122 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagactgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28123 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28124 - DNA, 350 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccagggctgcgtcctaaccggcgtctgggtcatagcccacgagtgcggccaccacgccttcagcgactac

SEQ ID NO: 28125 - DNA, 349 bp, Artificial
  Mutation in BnaA.FAD2.a introduced by TALE nuclease pair BnFAD2_T03
aggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28126 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcttcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28127 - DNA, 325 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 28128 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcacctcaagaaagaaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccagggctgcggcctaaccggcgtctgggtcatagcccacgagtgcggccaccacgccttcagcgactac

SEQ ID NO: 28129 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28130 - DNA, 463 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggcgatggcggcaagcaggcgctggagacggtccagcggctgttgccggtgctgtgccaggcccacggcttgaccccggagcaggcgggggccatcgccagcaataatggtgtagaactcaagaaagcaatcccaccgcactgtttcaaacgctcgatccctcgctctttctcctacctcatctgggacatcatcatagccccctgcttctactacgtcgccaccacctacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 28131 - DNA, 350 bp, Artificial
  Mutation in BnaA.FAD2.a introduced by TALE nuclease pair BnFAD2_T03
caggatccatgggtgcaggtgaaagaatgcaagtgtctactcactcccaaaagactgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgccccaacgggctcctgggtcttagcccacgagcgcgtcctccacgcctgtaacgactac

SEQ ID NO: 28132 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28133 - DNA, 398 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactgtcgggcgactgccctgctgcgtaacatcgttgctgctccataacatcggagaactcaagaaagcaatcccaccgcactgtttcaaacgctcgatccctcgctctttctcctacctcatctgggacatcatcatagcctcctgcttctcctacgtcgccaccacttacttccctctcctccctcaccctctctcctgcttcgcctggcctctctactgggcctgccaaggctgcgtcctaacgggcctctgggtcatagcccacgagtgcggccaccacgccttcagcgactac

SEQ ID NO: 28134 - DNA, 347 bp, Artificial
  Mutation in BnaA.FAD2.a introduced by TALE nuclease pair BnFAD2_T03
caggatccatgggtgcaggtggcagaatgcaagtggctcctccatccaaaaagtctgaaaccgacaccatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcggcctaaccggcgtctgggtcatagcccacgagtgcggccaccacgccttcagcgactac

SEQ ID NO: 28135 - DNA, 351 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28136 - DNA, 351 bp, Artificial
  Mutation in BnaA.FAD2.a introduced by TALE nuclease pair BnFAD2_T03
caggatccatgggtgcaggtgcaagaatgcaagtgtctcctccctcccaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28137 - DNA, 372 bp, Artificial
  Mutation in BnaA.FAD2.a introduced by TALE nuclease pair BnFAD2_T03
caggatccatgggtgcaggtggaagaatgcaagtgcctcctccctccaaaaagtctgaaaccgacaacatcaagcgcgtaccctgcgagacaccgcccttcactgctcacatgttctttcctgcgttatcccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28138 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28139 - DNA, 342 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28140 - DNA, 357 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28141 - DNA, 349 bp, Artificial
  Mutation in BnaA.FAD2.a introduced by TALE nuclease pair BnFAD2_T03
caggatccatgggtgcaggtggcagaatgcaagtgtctcctccctccaaaaaggctgaaaccgacaacatcaagcgcgtaccctgcgagacaccgcccttcactgtgaactcaagaaagcaatcccaccgcactgtttcaaacgctcgatgcctcgctctttctcctacctcatctgggacatcatcatagcctcctgcttctactacgtcgccaccacttacttccctctcctccctcaccctctctcctacttcgcctggcctctctactgggccggccagggctgcgtcctaaccggcgtctgggtcatagcccacgagtgcggccaccacgccttcagcgactac

SEQ ID NO: 28142 - DNA, 350 bp, Artificial
  Mutation in BnaA.FAD2.a introduced by TALE nuclease pair BnFAD2_T03
caggatccatgggtgcaggtgaaagaatgcaagtctctcctccctccagctcccccgaaaccaaaaccctcaaacgcgtcccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28143 - DNA, 349 bp, Artificial
  Mutation in BnaA.FAD2.a introduced by TALE nuclease pair BnFAD2_T03
caggatccatgggtgcaggtggaagaatgcaagtgtctactccctccagctcccccgaaaccaaaaccctcaaacgcgtcccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28144 - DNA, 308 bp, Artificial
  Mutation in BnaA.FAD2.a introduced by TALE nuclease pair BnFAD2_T03
caggatccatgggtgcaggtggcagaatgcaagtctctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28145 - DNA, 345 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28146 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 28147 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28148 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 28149 - DNA, 334 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctcttcgacatcatcatctcctcctcggctcctccctctaccacctctccacagcctacttccctctcccttacctcgcctggcccctctactgggcctgccaaggctgcgtcctaacgggcctctgggtcatcgcccacgagtgcggccaccacgccttcagcgactac

SEQ ID NO: 28150 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 28151 - DNA, 347 bp, Artificial
  Mutation in BnaA.FAD2.a introduced by TALE nuclease pair BnFAD2_T03
caggatccatgggtgcaggtggaagaatgcaagtgtctcctccctccagctcccccgaaaccaaaaacctcaaacgcgtcccctgcgagacaccacccttcactgacctcaagaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcggccaccacgccttcagcgactac

SEQ ID NO: 28152 - DNA, 354 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28153 - DNA, 389 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcttcaagtatgacgggctgatactgggccggcaggcgctccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28154 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtctccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttcccgctcctccctcaccctctctcctacttcgcctggcctctctactgggcctgccagggctgcgtcctaaccggcgtctgggtcatagcccacgagtgcggccaccacgccttcagcgactac

SEQ ID NO: 28155 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgcgcctgccagggctgcgtcctaaccggcgtctgggtcatagcccacgagtgcggccaccacgcctgcagcgactac

SEQ ID NO: 28156 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacataaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28157 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28158 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28159 - DNA, 347 bp, Artificial
  Mutation in BnaA.FAD2.a introduced by TALE nuclease pair BnFAD2_T03
caggatccatgggtgcaggtggcagaatgcaagtgtctactccctccaagaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28160 - DNA, 349 bp, Artificial
  Mutation in BnaA.FAD2.a introduced by TALE nuclease pair BnFAD2_T03
caggatccatgggtgcaggtgcaagaatgcaagtctctcctccctccagctcccccggaaccaacaccctcaaacgcgtcccctgcgagacaccaccattcactcggacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28161 - DNA, 336 bp, Artificial
  Mutation in BnaA.FAD2.a introduced by TALE nuclease pair BnFAD2_T03
caggatccatgggtgcaggtggaagaatgcaagtgtcccctccctacaaaaagtctgaaaccgacaacatcaagcgcgtaccctgcgagacaccgcccttcactgtagaactcaagaaagcaatcccaccgcactgcttcaaacgctccatcccacgctccttctcctcttcgacatcatcatctcctcctcggctcctccctctaccacctctccgcagcctacttccctctcccttacctcgcctgacccctctactgggcctgccaaggctgcgtcctaacgggcctctgggtcatagcccacgagtgcggccaccacgccttcagcgactac

SEQ ID NO: 28162 - DNA, 324 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28163 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 28164 - DNA, 344 bp, Artificial
  Mutation in BnaA.FAD2.a introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28165 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcacagaactcaagaaagcaatcccaccgcactgtttctaacgcccgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28166 - DNA, 349 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgtgacatcatcatagcctcctgcctctactacgtcgccaccacctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28167 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaaccggcgtctgggtcatagcccacgagtgcggccaccacgccttcagcgactac

SEQ ID NO: 28168 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28169 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28170 - DNA, 345 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 28171 - DNA, 349 bp, Artificial
  Mutation in BnaA.FAD2.a introduced by TALE nuclease pair BnFAD2_T03
caggatccatgggtgcaggtggcagaatgcaagtgtctactccctccaagaagtctgaaaccgacaccgtcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28172 - DNA, 331 bp, Artificial
  Mutation in BnaA.FAD2.a introduced by TALE nuclease pair BnFAD2_T03
caggatccatgggtgcaggtgacagaatgcaagtttctcctccctccagctcccccgaaaccaaaaccctaaaacgcgtcccctgcgggacctcaagaaagcaatcccacctcactgctccaaacgcacgatccctcgctctttctcctacctcatctgggacatcatcatagcctcctgcttctactacgtcgccaccacttacttccctctcctccctcaccctctctcctacttcgcctggcctctctactgggcctgccatggctgcggcctaaccggcgtctgggtcatagcccacgagtgcggccaccacgccttcagcgactac

SEQ ID NO: 28173 - DNA, 351 bp, Artificial
  Mutation in BnaA.FAD2.a introduced by TALE nuclease pair BnFAD2_T03
caggatccatgggtgcaggtggcagaatgcaagtgtctactcaatccaaaaagcctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28174 - DNA, 355 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagctactac

SEQ ID NO: 28175 - DNA, 349 bp, Artificial
  Mutation in BnaA.FAD2.a introduced by TALE nuclease pair BnFAD2_T03
caggatccatgggtgcaggtggaagaatgcaagtgtctcctccctcccaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28176 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 28177 - DNA, 344 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgcctgcagcgactac

SEQ ID NO: 28178 - DNA, 355 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 28179 - DNA, 346 bp, Artificial
  Mutation in BnaA.FAD2.a introduced by TALE nuclease pair BnFAD2_T03
caggatccatgggtgcaggtggaagaatgcaagtgtctcatccctacaagaagtctgaaaccgacaccatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28180 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttcactctcctccctcaccctctctcctacttcgcctggcctctctactgggcctgccagggctgcgtcctaacgggcctctgggtcatagcccacgagtgcggccaccacgccttcagcgactac

SEQ ID NO: 28181 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctctctcaccctctctcctacttcgcctggcctctctactgggcctgccagggctgcgtcctaaccggcgtctgggtcatagcccacgagtgcggccaccacgccttcagcgactac

SEQ ID NO: 28182 - DNA, 403 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttggcgatggccaccacctgctggggggtcaagccgtgggcctggcacagcaccagaactcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcggcctaaccggcgtctgggtcatagcccacgagtgcggccaccacgccttcagcgactac

SEQ ID NO: 28183 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcgaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28184 - DNA, 396 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggttcctggccttttgctggccttttgctcccatgttctttccggagaactcaagaaagcaatcccacctcactgcttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 28185 - DNA, 348 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctcgctactgggccggccaagggtgcgtcctaaccggcgtctgggtcatagcccacgagtgcggccaccacgccttcagcgactac

SEQ ID NO: 28186 - DNA, 407 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtggacaccaaggcctactccggcggctacaacctgcccatcggccaggccgacgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 28187 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctccctactgggcctgccaagggtgcgtcctaaccggcgtctgggtcatcgcccacgaatgcggccaccacgccttcagcgactac

SEQ ID NO: 28188 - DNA, 383 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttaagcgcggcgggtgtggtgggttcgcgcataagtgaagggcggtgtaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28189 - DNA, 349 bp, Artificial
  Mutation in BnaA.FAD2.a introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcactgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28190 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28191 - DNA, 349 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcgcgactac

SEQ ID NO: 28192 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28193 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28194 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcctctctactgggcctgccagggctgcgtcctaaccggcgtctgggtcatagcccacgagtgcggccaccacgccttcagcgactac

SEQ ID NO: 28195 - DNA, 351 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 28196 - DNA, 351 bp, Artificial
  Mutation in BnaA.FAD2.a introduced by TALE nuclease pair BnFAD2_T03
caggatccatgggtgcaggtgaaagaatgcaagtgtctcctccctccaaaaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28197 - DNA, 356 bp, Artificial
  Mutation in BnaA.FAD2.a introduced by TALE nuclease pair BnFAD2_T03
caggatccatgggtgcaggtgaaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28198 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcccacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28199 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtccgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 28200 - DNA, 349 bp, Artificial
  Mutation in BnaA.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacagcatcatagcctcctgcttctactacgtcgccaccacttacttccctctcctccctcaccctctctcctacgtcgcctggcctctctactgggcctgccagggctgcgtcctaaccggcgtctgggtcatagcccacgaatgctgccaccacgccttcagcgactac

SEQ ID NO: 28201 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28202 - DNA, 370 bp, Artificial
  Mutation in BnaA.FAD2.a introduced by TALE nuclease pair BnFAD2_T03
caggatccatgggtgcaggtggaagaatgcaagtttctcctccctccaaaaagcctgaaaccgacaacctcaaacgcgtaccctgcgagacaccgcccttcactgtcgttcggctccggcgcgcggagacctcaagaaagcaatcccaccgcactgtttcaaacgccccatccctcgctctttctcctacctcctctgggacatcatcataccctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 28203 - DNA, 317 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28204 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttcttctccctcatctgggacatcatcatagcctcctgcttctactacgtcgccaccacttacttccctctcctccctcaccctctctcctacttcgcctggcctctttactgggcctgccagggctgcgtcctaaccggcgtctgggtcatagcccacgagtgcggccaccacgccttcagcgactac

SEQ ID NO: 28205 - DNA, 336 bp, Artificial
  Mutation in BnaA.FAD2.a introduced by TALE nuclease pair BnFAD2_T03
caggatccatgggtgcaggtggcagaatgcaagtgtctcctccctacaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggccggccaaggctgcgtcctaacgggcctctgggtcatagcccacgagtgcggccaccacgccttcagcgactac

SEQ ID NO: 28206 - DNA, 349 bp, Artificial
  Mutation in BnaA.FAD2.a introduced by TALE nuclease pair BnFAD2_T03
caggatccatgggtgcaggtggcagaatgcaagtgtctaatccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28207 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatggcccacgagtgcggccaccacgccttcagcgactac

SEQ ID NO: 28208 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagaaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28209 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgaccaccacgccttcagcgactac

SEQ ID NO: 28210 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccagggctgcgtcctaaccggcgtctgggtcatagcccacgagtgcggccaccacgccttcagcgactac

SEQ ID NO: 28211 - DNA, 351 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtggagaactcaagaaagcaatcccaccgcactgtttcaaacactcgatccctcgctctttctcctacctcatctggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28212 - DNA, 349 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28213 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgaacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28214 - DNA, 317 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagtgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28215 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccctgcgagacaccgcccttcactgtcgttcggctgcggcgagcggagaactcaagaaatcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28216 - DNA, 295 bp, Artificial
  Mutation in BnaA.FAD2.a introduced by TALE nuclease pair BnFAD2_T03
caggatccatgggtgcaggtggcagaatgcaagtgtctcctccctccaaaaagcctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28217 - DNA, 350 bp, Artificial
  Mutation in BnaA.FAD2.a introduced by TALE nuclease pair BnFAD2_T03
caggatccatgggtgcaggtggaagaatgcaagtgtctcctccctcccaaaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28218 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcacgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28219 - DNA, 350 bp, Artificial
  Mutation in BnaA.FAD2.a introduced by TALE nuclease pair BnFAD2_T03
caggatccatgggtgcaggtggcagaatgcaagtgtctactcactccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 28220 - DNA, 342 bp, Artificial
  Mutation in BnaA.FAD2.a introduced by TALE nuclease pair BnFAD2_T03
caggatccatgggtgcaggtggaagaatgcaagtgtctcctcccttcaagaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28221 - DNA, 408 bp, Artificial
  Mutation in BnaA.FAD2.a introduced by TALE nuclease pair BnFAD2_T03
caggatccatgggtgcaggtgcaagaatgcaagtgtctactcaatccaaaaagactgaaaccgacaacatgcagcgcgtaccctgcgagacaccgcccttcactgtcggggccaagccgcgggcctggcgcagcaccggcaacagccgctggaccgtctccaggagaactcaagaaagcaatcccaccgcactgtttcaaacgctcgatccctcgctctttctcctacctcatctgggacatcatcatagcctccttcttctgcttcgtcgccgccccttacgtccctctcctccctcaccctctctcctactgcgcctggcctctctactgggcctgccagggctgcgacctaaccggcgtctgggtcatagcccacgagtgccgccaccaccccgtcagcaactac

SEQ ID NO: 28222 - DNA, 349 bp, Artificial
  Mutation in BnaA.FAD2.a introduced by TALE nuclease pair BnFAD2_T03
caggatccatgggtgcaggtggaagaatgcaagtgtctactccctccaaaaagactgaaaccgacaacatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28223 - DNA, 350 bp, Artificial
  Mutation in BnaA.FAD2.a introduced by TALE nuclease pair BnFAD2_T03
caggatccatgggtgcaggtgcaagaatgcaagtgtctcctccatccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28224 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcacactcaagaaagcaatcccacctcactgcttcaaacgctccatcccacgctccttctcctcttcgacctcatcatctcctcctcgcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28225 - DNA, 350 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28226 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggctgcggtgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28227 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28228 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgagaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 28229 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcttctgggtcatagcccacgagtgcggccaccacgccttcagcgactac

SEQ ID NO: 28230 - DNA, 349 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28231 - DNA, 351 bp, Artificial
  Mutation in BnaA.FAD2.a introduced by TALE nuclease pair BnFAD2_T03
caggatccatgggtgcaggtggcagaatgcaagtgtctcctccctccaaaaagcctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactcggcctgccaagggtgcgtcctaacgggcctctgggtcatagcccacgagtgcggccaccacgccttcagcgactac

SEQ ID NO: 28232 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 28233 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcctggcctctctactgggcctgccaagggtgcgtcctaaccggcgtcggggtcatagcccacgagtgcggccaccacgccttcagcgactac

SEQ ID NO: 28234 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagacgactgaaaccgacaacatcaagcgcgtaccctgcgagacaccgcccttcactgtgaactcacgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28235 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28236 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 28237 - DNA, 398 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtacttcaagtgtctcctccctccaaaaagtctgaaaccgacaacatacgcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 28238 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28239 - DNA, 357 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28240 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28241 - DNA, 346 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28242 - DNA, 323 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 28243 - DNA, 349 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28244 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28245 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28246 - DNA, 349 bp, Artificial
  Mutation in BnaA.FAD2.a introduced by TALE nuclease pair BnFAD2_T03
caggatccatgggtgcaggtggaagaatgcaagtgtctactcactccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 28247 - DNA, 350 bp, Artificial
  Mutation in BnaA.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28248 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacgcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28249 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 28250 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttcttccaccgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 28251 - DNA, 349 bp, Artificial
  Mutation in BnaA.FAD2.a introduced by TALE nuclease pair BnFAD2_T03
caggatccatgggtgcaggtggaagaatgcaagtgtctcccccctccaagaagactgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28252 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28253 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28254 - DNA, 349 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctggcctctctactgggcctgccagggctgcgtcctaacgggcctctgggtcatagcccacgagtgcggccaccacgccttcagcgactac

SEQ ID NO: 28255 - DNA, 351 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagactcctgcttctactacttcgccaccacttacttccctctcctccctcaccctctctccttcttcgcctagcctctctactgggcatgccaagggtgcgtcctaaccggcgtcggggtcatagcccacgagtgcggccaccacgccttcagcgactac

SEQ ID NO: 28256 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgacta

SEQ ID NO: 28257 - DNA, 345 bp, Artificial
  Mutation in BnaA.FAD2.a introduced by TALE nuclease pair BnFAD2_T03
caggatccatgggtgcaggtgcaagaatgcaagtctcccctccatccagctcccccggacccaacaccctcaaacgcgtcccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28258 - DNA, 372 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcggtttcccgactggaaagcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28259 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacaccaagcgcgtaccctgcgagacaccgcccttcactatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28260 - DNA, 468 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagggcgtaccctgcgagacaccgcccttcactgtcggattgcaaaacgtggcggcgtgaccgcagtggaggcagtgcatgcatggcgcaatgcactgacgggtgccccgctcaacttgaccccccagcaggtggtggccatcgccagcacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28261 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttactcccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28262 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaaacaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28263 - DNA, 319 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28264 - DNA, 349 bp, Artificial
  Mutation in BnaA.FAD2.a introduced by TALE nuclease pair BnFAD2_T03
caggatccatgggtgcaggtggaagaatgcaagtgtctcccccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28265 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28266 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagtccacgagtgcggccaccacgccttcagcgactac

SEQ ID NO: 28267 - DNA, 373 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacactgccaggcatcaaactaagcagaaggccatccgtcaaacgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagccaacgagtgcggccaccacgccttcagcgactac

SEQ ID NO: 28268 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 28269 - DNA, 411 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtcggcgctcggtcgttcggctgcggcgagcggtatcagctcactcaaaggcggtaatacggtagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28270 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttactcccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28271 - DNA, 348 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaaccgcgtaccctgcgagacaccgcccttcactggaactcaagaaagcaatcccaccgcactgtttcaaacgctcgatccctcgctctttctcctacctcatctgggacatcatcatagcctcctgcctctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28272 - DNA, 346 bp, Artificial
  Mutation in BnaA.FAD2.a introduced by TALE nuclease pair BnFAD2_T03
caggatccatgggtgcaggtggaagaatgcaagtgtcacctccctccaaaaagtctgaaaccgacaacatcaagcgcgtaccctgcgagacaccgcccttcactgactcaagaaagcagtcccaccgcactgtttcaaacgctcgatccctcgctctttctcctacctcatctgggacatcatcatagcctcctgcttctactacgtcgccaccacttacctccctctcctccctcaccctctctcctactgcgcctggcctctctactgggcctgccagggctgcgtcctaaccggcgtctgggtcatagcccacgagtgcggccaccacgccttcagcgactac

SEQ ID NO: 28273 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28274 - DNA, 351 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggactgcgtcctaaccggcgtctgggtcatagcccacgagtgcggccaccacgccttcagcgactac

SEQ ID NO: 28275 - DNA, 343 bp, Artificial
  Mutation in BnaA.FAD2.a introduced by TALE nuclease pair BnFAD2_T03
caggatccatgggtgcaggtggaagaatgcaagtctctactcactccagctcccccggaaccaacaccctcaaacgcgtcccctgcgagacaccaccattcactcgagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 28276 - DNA, 433 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaccatcaagcgcgtaccctgcgagacaccgcccttcactgtcggcggtggcaagcaggcgctggagacggtccagcggctgtttccggtgctgtgccaggcccacggcttgaccccccagcaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 28277 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28278 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggactgccagggctgcgtcctaaccggcgtctgggtcatagcccacgagtgcggccaccacgccttcagcgactac

SEQ ID NO: 28279 - DNA, 268 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccagggctgcgtcctaaccggcgtctgggtcatagcccacgagtgcggccaccacgccttcagcgactac

SEQ ID NO: 28280 - DNA, 350 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 28281 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgacta

SEQ ID NO: 28282 - DNA, 349 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 28283 - DNA, 401 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgcccgccaccctccgggccgttgcttcacaacgttcaaatccgctcccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28284 - DNA, 433 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggtggcaagcaggcgctggagacggtccagcggctgttgccggtgctgtgccaggcccacggcttgaccccccagcaggagaactcaagaaagcaatcccaccgcactgtttcaaacgctcgatccctcgctctttctcctacctcatctgggacatcatcatagcctcctgcttctactacgtcgccaccacttacttccctcgcctccctcaccctctctcctacttcgcctggcctctctactgggcctgccagggctgcgtcctaaccggcgtctgggtcatagcccacgagtgcggccaccacgccttcagcgactac

SEQ ID NO: 28285 - DNA, 389 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgatttcttgtcaaaaatgctccactgacgttccataaattcagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctagcgggcgtctgggtcatagcccacgagtgcggccaccacgccttcagcgactac

SEQ ID NO: 28286 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 28287 - DNA, 350 bp, Artificial
  Mutation in BnaA.FAD2.a introduced by TALE nuclease pair BnFAD2_T03
caggatccatgggtgcaggtggaagaatgcaagtgtctcctctctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28288 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccctgcgagacaccgcccttcactgactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcggcctaacgggcctctgggtcatcgcccacgaatgcggccaccacgccttcagcgactac

SEQ ID NO: 28289 - DNA, 348 bp, Artificial
  Mutation in BnaA.FAD2.a introduced by TALE nuclease pair BnFAD2_T03
caggatccatgggtgcaggtggaagaatgcaagtgtctcctccctcaaaaaaggctgaaaccgacaaaatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccactagtgcggccaccacgccttcagcgactac

SEQ ID NO: 28290 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28291 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgtgtcatagcccacgagtgcggccaccacgccttcagcgactac

SEQ ID NO: 28292 - DNA, 351 bp, Artificial
  Mutation in BnaA.FAD2.a introduced by TALE nuclease pair BnFAD2_T03
caggatccatgggtgcaggtggaagaatgcaagtgtctactcactccaaaaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 28293 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 28294 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgctccctcgctctttctcctacctcatctgggacatcatcatagcctcctgcttctactacgtcgcccccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28295 - DNA, 408 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaacagccgctggaccgtctccaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28296 - DNA, 350 bp, Artificial
  Mutation in BnaA.FAD2.a introduced by TALE nuclease pair BnFAD2_T03
aaggatcaatgggtgcaggtggaagaatgcaagtgtctcctcccgacaaaaagtctgaaaccgacaacatcaagcgcgtaccctgcgagacaccgccagtcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28297 - DNA, 350 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtagaactcaagaaagcaatcccaccgcactgtttcaaacgctcgatccctcgctctttctcctatctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28298 - DNA, 341 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaaagcaatcccaccgcactgtttcaaacgctcgatccctcgctccttctactacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28299 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccgcactgtttcaaccgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28300 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctgagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgagtgcggccaccacgccttcagcgactac

SEQ ID NO: 28301 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28302 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgagaactccagaaagcaatccccccgcactgtttcaaacgctcgatccctcgctctttctcctacctcatctgggacatcatcatagcctcctgcttctcctacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28303 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28304 - DNA, 402 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28305 - DNA, 279 bp, Artificial
  Mutation in BnaA.FAD2.a introduced by TALE nuclease pair BnFAD2_T03
caggatccatgggtgcaggtggaagaatgcaagtctctcctccctccagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28306 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggccgcgtcctaaccggcgtctgggtcatagcccacgagtgcggccaccacgccttcagcgactac

SEQ ID NO: 28307 - DNA, 403 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgttggcgatggccaccacctgctggggggtcaagccgtgggcctggcacagcaccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28308 - DNA, 395 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaggcccacggcttgaccccggagcaggtggtggccatcgccagcaatattggtggcggagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctcctgggcctgccagggctgcgtcctaaccggcgtctgggtcatagcccacgagtgcggccaccacgccttcagcgactac

SEQ ID NO: 28309 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 28310 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28311 - DNA, 368 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagcaatggcggtggctggagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28312 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacttcgccaccacttacttccctctcctccctcaccctctctcctacttcccctggcctctctactgggcctgccaaggttgcgtcctaaccggcgtctgggtcatagcccacgagtgcggccaccacgccttcagcgactac

SEQ ID NO: 28313 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 28314 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttaccgcgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28315 - DNA, 351 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgagtgcggccaccacgccttcagcgactac

SEQ ID NO: 28316 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 28317 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcatgcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaaccggcgtctgggtcatagcccacgagtgcggccaccacgccttcagcgactac

SEQ ID NO: 28318 - DNA, 340 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtacggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28319 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28320 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactataactcaagaaagcaatcccaccgcactgtttcaaacgctcgatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28321 - DNA, 382 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgatagttgagtcgatacttcggcgatcaccgctgaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctgacccctctactgggcctgccaaggctgcgtcctaacgggcctctgggtcatagcccacgagtgcggccaccacgccttcagcgactac

SEQ ID NO: 28322 - DNA, 380 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgatggccaccacctgctccggggtcaagccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactac

SEQ ID NO: 28323 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 28324 - DNA, 349 bp, Artificial
  Mutation in BnaA.FAD2.a introduced by TALE nuclease pair BnFAD2_T03
caggatccatgggtgcaggtggaagaatgcaagtatctcctccctccaaaaagactgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28325 - DNA, 325 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28326 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 28327 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28328 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcataacccacgagtgcggccaccacgccatcagcgactac

SEQ ID NO: 28329 - DNA, 347 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactcaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctacggggcctgccaaggctgcgtcctaacgggcctctgggtcatcgcccacgaatgcggccaccacgccttcagcgactac

SEQ ID NO: 28330 - DNA, 347 bp, Artificial
  Mutation in BnaA.FAD2.a introduced by TALE nuclease pair BnFAD2_T03
caggatccatgggtgcaggtgtaagaatgcaagtgtctcctccctccaagaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28331 - DNA, 348 bp, Artificial
  Mutation in BnaA.FAD2.a introduced by TALE nuclease pair BnFAD2_T03
caggatccatgggtgcaggtggaagaatgcaagtgtatccaccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28332 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggtctctctactgggcctgctagggctgcgtcctaaccggcgtctgggtcatagcccacgagtgcggccaccacgccttcagcgactac

SEQ ID NO: 28333 - DNA, 349 bp, Artificial
  Mutation in BnaA.FAD2.a introduced by TALE nuclease pair BnFAD2_T03
caggatccatgggtgcaggtggaagaatacaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28334 - DNA, 456 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggctgttgccggtgctgtgccaggcccacggcttgaccccggagcaggtggtggccatcgccagcaatattggtggcaagcaggcgctggagacggggcaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 28335 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 28336 - DNA, 347 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcacttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggactgcgtcctaaccggcgtctgggtcatagcccacgagtgcggccaccacgcctgcagcgactac

SEQ ID NO: 28337 - DNA, 380 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28338 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgtgagacaccacccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggtctgccagggctgcgtcctaacgggcctctgggtcatcgcccacgaatgcggccaccacgccttcagcgactac

SEQ ID NO: 28339 - DNA, 299 bp, Artificial
  Mutation in BnaA.FAD2.a introduced by TALE nuclease pair BnFAD2_T03
caggtccatgggtgcaggtggaagaatgcaagtctctcctccctccagctcccccgaaaccaaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28340 - DNA, 350 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28341 - DNA, 343 bp, Artificial
  Mutation in BnaA.FAD2.a introduced by TALE nuclease pair BnFAD2_T03
caggatccagggtgcaggtggaagaatgcaagtgtctcctccctccaagaagtctgaaaccgacaccatcaagcgcgtaccctgcgagacaccgcccttcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28342 - DNA, 434 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggaccgtctccagcgcctgcttgccaccgccattgctggcgatggccaccacctgctggggggtcaagccgtgggcctggcggagacctcaagaaagcaatcccacctcactgcttcaaacgctccatccctcgctctttctcctacctcagctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28343 - DNA, 340 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaagtctgcgtcctaacgggcctctgggtcatagcccacgagtgcggccaccacgccttcagcgactac

SEQ ID NO: 28344 - DNA, 347 bp, Artificial
  Mutation in BnaA.FAD2.a introduced by TALE nuclease pair BnFAD2_T03
caggatccatgggtgcaggtggaataatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28345 - DNA, 379 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggtcatagcattggatcggatcccgggcccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28346 - DNA, 374 bp, Artificial
  Mutation in BnaA.FAD2.a introduced by TALE nuclease pair BnFAD2_T03
caggatccatgggtgcaggtggaagaatgcaagtgtcccctccctccaagaagactgaaaccgacaccatcaagcgcgtaccctgcgagacaccgcccttcactaactccagaaacccgcggctgagtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 28347 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcaagcaatcccaccgcactgtttcaaacgctcgatccctcgctctttctcctacctcatctgggacataatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 28348 - DNA, 437 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcgcctgcttgccaccattattgctggcgatggccaccacctgctggggggtcaagttgagcggggcacccgtcagtgcatgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcagggctgcgtcctaaccggcgtctgggtcatagcccacgagtgcggccaccacgccttcagcgactac

SEQ ID NO: 28349 - DNA, 436 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaccccggagcagggggtggccatcgccagcactattggtggcgagcaggcgctggagacggtgcaggtggtggggtcaagccgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28350 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagactgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28351 - DNA, 349 bp, Artificial
  Mutation in BnaA.FAD2.a introduced by TALE nuclease pair BnFAD2_T03
caggatccatgggtgcaggtggaagaatgcaagtgtctacttcctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28352 - DNA, 348 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 28353 - DNA, 336 bp, Artificial
  Mutation in BnaA.FAD2.a introduced by TALE nuclease pair BnFAD2_T03
caggatccatgggtgcaggtggaagaatgcaagtgtctcctccctccaagaagtctgaaacctacaccatcaaacgcgtcccctgcgagacaccacccttcactctccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28354 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcatcctctctcctacttcgcctggcctctctactgggcctgccagggctgcgtcctaaccggcgtctgggtcatagcccacgagtgcggccaccacgccttcagcgactac

SEQ ID NO: 28355 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28356 - DNA, 334 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 28357 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28358 - DNA, 428 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtgtgactggtgaatctgccaatgtaaataatccatcacccaaatcaagttttttggggtcgaggtgccgtaaagcaagaactcaagaaagcaatcccaccgcactgtttcaaacgctcgatccctcgctctttctcctacctcatctgggacatcatcatagcctcctgcttctactacgtcgccaccacttacttccctctcctccctcaccctttctcctacttcgcctggcctctctactggacctgccagggctgcgtcctaaccggcgtctgggtcatagcccacgagtgcggccaccacgccttcagcgactac

SEQ ID NO: 28359 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacataaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctggcctctctactgggcctgccagggctgcgtcctaaccggcgtctgggtcatagcccacgagtgcggccaccacgccttcagcgactac

SEQ ID NO: 28360 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccctgcgagacaccgcccgagacctcaagaaagcaatcccaccgcactgtttcaaacgctcgatccctcgctctttctcctacctcatctgggacatcatcatctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28361 - DNA, 316 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctccaatatttaccttccctccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28362 - DNA, 391 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacccgcttcctcgctcactgactcgctgcgctcggtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28363 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggtctctctattgggcctgccagggctgcgtcctaacgggcctctgggtcatcgcccacgaatgcggccaccacgccttcagcgactac

SEQ ID NO: 28364 - DNA, 349 bp, Artificial
  Mutation in BnaA.FAD2.a introduced by TALE nuclease pair BnFAD2_T03
caggatccatgggtgcaggtggaagaatgcaagtgtctactccctccaaaaagcctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28365 - DNA, 403 bp, Artificial
  Mutation in BnaA.FAD2.a introduced by TALE nuclease pair BnFAD2_T03
caggatccatgggtgcaggtggcagaatgcaagtgtctcccccctccaaaaagtctgaaaccgacaacatcaagcgcgtaccctgcgagacaccgcccttcactgtcgaaccttcggtttgatcttctcctgttgctcggctatgtgccaggccatgctagaactcaagaaagcaatcccaccgcactgtttcagacgctcgatccctcgctctttctcctacctcatctgggacatcatcatagcctcctgctcctactccgtcgccaccacttacttccctctcctccctcaccctctcgcctactgcgcctggcctctctactgggcctgccaagggtgcgtcctaaccggcgtctgggtcatagcccacgagtgcgaccaccacaccttcagcgactac

SEQ ID NO: 28366 - DNA, 349 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgccgggcctctctacttggcctgccagggctgcgtcctaaccggcgtctgggtcatagcccacgagggcggccaccacgccttcagcgactac

SEQ ID NO: 28367 - DNA, 335 bp, Artificial
  Mutation in BnaA.FAD2.a introduced by TALE nuclease pair BnFAD2_T03
caggatccatggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctcttcgacaccatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 28368 - DNA, 342 bp, Artificial
  Mutation in BnaA.FAD2.a introduced by TALE nuclease pair BnFAD2_T03
caggatccatgggtgcaggtggaagaatgcaagtgtctcctgcctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28369 - DNA, 338 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28370 - DNA, 345 bp, Artificial
  Mutation in BnaA.FAD2.a introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgctgctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28371 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaaccttcggtttgatcttctcctgttgctcggctatgtgccaggccatgctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28372 - DNA, 418 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacctctgacttgagcgtcgatttttgtgatgctcgtcagggggggccatcgccagcaatggcggcggcaggccggcgctgggacctcaagaaagcaatcccacctcactgcttcaaacgctcgatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatcgcccacgaatgcggccaccacgccttcagcgactac

SEQ ID NO: 28373 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28374 - DNA, 324 bp, Artificial
  Mutation in BnaA.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28375 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 28376 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 28377 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 28378 - DNA, 416 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctagttaccggataaggcgcagcggtcgggctgaacgggggtgtagatggcgccgtcgggcttcgaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28379 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28380 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgacgggagaactcaagaaagcaatcccaccgcactgtttcaaacgctcgatcactcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28381 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgtcaccacttacttccctctcctccctcaccctctctcctacttcgcctggcctctctactgggcctgccagggctgcggcctaacgggcctctgggtcatagcccacgagtgcggccaccacgccttcagcgactac

SEQ ID NO: 28382 - DNA, 408 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggacttcgctgctacccaaggttgccgggtgacgcacaccgtggaaacggatgaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 28383 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactgcccttcactgtactcaagaaagcaatcccaccgcactggttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28384 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccggagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28385 - DNA, 357 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttttgttagaactcaagaaagcactcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28386 - DNA, 357 bp, Artificial
  Mutation in BnaA.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcactgtttttgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28387 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28388 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccctgcgagacaccgcccttcactatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 28389 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctcgcctccctcaccctctctcctacttcgcctggcctctctactgggcctgccagggctgcgtcctaaccggcgtctgggtcatagcccacgagtgcggccaccacgccttcagcgactac

SEQ ID NO: 28390 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28391 - DNA, 365 bp, Artificial
  Mutation in BnaA.FAD2.a introduced by TALE nuclease pair BnFAD2_T03
caggatccatgggtgcaggtggaagaatgcaagtgtctcctccctccaaaaagtcttaactcaattcttgtgggttatctcactgactcgctgcgctcggtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcatggctgcgtcctaaccggcgtctgggtcatagcccacgagtgcggccaccacgccttcagcgactac

SEQ ID NO: 28392 - DNA, 350 bp, Artificial
  Mutation in BnaA.FAD2.a introduced by TALE nuclease pair BnFAD2_T03
caggatccatgggtgcaggtggaagaatgcaagtgtctactccctccaaaaagactgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28393 - DNA, 316 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28394 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28395 - DNA, 419 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgtccagcggctgttgccggtgctgtgccaggcccacggctttacccctccgcaagtggtggccatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28396 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccagggctgcgtcctaaccggcgtctgggtcatagcccacgagtgcggccaccacgccttcagcgactac

SEQ ID NO: 28397 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcggcctaaccggcgtctgggtcatagcccacgagtgcggccaccacgccttcagcgactac

SEQ ID NO: 28398 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 28399 - DNA, 349 bp, Artificial
  Mutation in BnaA.FAD2.a introduced by TALE nuclease pair BnFAD2_T03
caggatccatgggtgcaggtggcagaatgcaagtgtatcctcactccaaaaagcctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggcggcgtcctaaccggcgtctgggtcatagcccacgagtgcggccaccacgccttcagcgactac

SEQ ID NO: 28400 - DNA, 348 bp, Artificial
  Mutation in BnaA.FAD2.a introduced by TALE nuclease pair BnFAD2_T03
caggatccatgggtgcaggtggaagaatgcaagtgtccactcactccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacggcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 28401 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgcctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28402 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaataaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28403 - DNA, 344 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccattaagccacgatggcggcaagcaggcgctggagaactcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28404 - DNA, 349 bp, Artificial
  Mutation in BnaA.FAD2.a introduced by TALE nuclease pair BnFAD2_T03
caggatccatgtgtgcaggtggaagaatgtaagtgtatcctccctccaaaaagtctgaaaccgacaacatcaagcgcgtaccctgcgagacaccgcccttcacttagaactcaagaaagcaatcccaccgcactgtttcaaatgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28405 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgcagaactcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28406 - DNA, 334 bp, Artificial
  Mutation in BnaA.FAD2.a introduced by TALE nuclease pair BnFAD2_T03
caggatccatgggtgcaggtggaagaatgcaagtgtaaactccctccaaaaagtctgaaaccgacaacatcaagcgcgtaccctgcgagacaccgcccttcactgtaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28407 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgtccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccagggctgcgtcctaaccggcgtctgggtcatagcccacgagtgcggccaccacgccttcagcgactac

SEQ ID NO: 28408 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatcccaagctctttctcctacctcatctgggacatcatcataacctcctgcttctactacggcgccaccacgtacgaccctcgcctacctcacccgctcgcctactacgccaggcctctctactgggcctgccagggctgcgtgctaaccggggaaggggtcatagcccacgagtgcggccaccacgccttcagcgactac

SEQ ID NO: 28409 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcgaccaccacgccttcagcgactac

SEQ ID NO: 28410 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcctctctactgggcctgccagggctgcgtcctaaccggcgtctgggtcatagcccacgagtgcggccaccacgccttcagcgactac

SEQ ID NO: 28411 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctaccagggctgcgtcctaaccggcgtctgggtcatagcccacgagtgcggccaccacgccttcagcgactac

SEQ ID NO: 28412 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacataaagcgcgtaccctgcgagacaccgcccttcactgtgagaactcaagaaagcaatcccaccgcactgtttcaaacgctcgatccctcgctatttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28413 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcacacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 28414 - DNA, 348 bp, Artificial
  Mutation in BnaA.FAD2.a introduced by TALE nuclease pair BnFAD2_T03
caggatccatgggtgcaggtggcagaatgcaagtgtcacctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28415 - DNA, 377 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcgctcggtcgttcggctgcggcgagcggtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgagtgcggccaccacgccttcagcgactac

SEQ ID NO: 28416 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 28417 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgatac

SEQ ID NO: 28418 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaccatcaagcgcgtaccctgcgagacaccgcccttcactgtagaactcaagaaagcaatcccaccgccctgtttcaaacgcccgatccctcgctctttctcctacctcatctgggccctcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28419 - DNA, 421 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccctgcgagacaccgcccttcactgtgcaccggcaacagccgctggaccgtctccagcgcctgcttgccgccatcgtggctggcgatggccaccacctgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28420 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 28421 - DNA, 343 bp, Artificial
  Mutation in BnaA.FAD2.a introduced by TALE nuclease pair BnFAD2_T03
cagtccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28422 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28423 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 28424 - DNA, 349 bp, Artificial
  Mutation in BnaA.FAD2.a introduced by TALE nuclease pair BnFAD2_T03
caggatccatgggtgcaggtggaagaatgcaagtgtctcctgcctccaaaaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28425 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaacacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28426 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28427 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28428 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcccctctactgggcctgccaaggctgcgtcctaacgggcctctgggtcatagcccacgagtgcggccaccacgccttcagcgactac

SEQ ID NO: 28429 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28430 - DNA, 394 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgccggtgctgtgccaggcccacggcttgaccccccagcaggtggtgggaactcaagaaagcaatcccaccgcactgtttcaaacgctcgatccctcgctctttcccctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28431 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggcctgcgtcctaaccggcgtctgggtcatagcccacgagtgcggccaccacgccttcagcgactac

SEQ ID NO: 28432 - DNA, 344 bp, Artificial
  Mutation in BnaA.FAD2.a introduced by TALE nuclease pair BnFAD2_T03
caggatccatgggtgcagtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28433 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28434 - DNA, 348 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28435 - DNA, 381 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttcgaggcatttctgtcctggctggtctagaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28436 - DNA, 335 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacacacctcaagaaagcaatcccaccgcactgtttcaaacgctcgatacctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28437 - DNA, 408 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaacagccgctggaccgtctccaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28438 - DNA, 438 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgtgccacgctgagagccagaagcaaatgaaaaatctaaagggggtcaagccgtgggcctggcacagcaccggcaacagccgctggacaagaactcaagaaagcaatcccaccgcactgtttcacacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28439 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgatcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccgtcgtctgggtcatagcccacgagtgcggccaccacgccttcagcgactac

SEQ ID NO: 28440 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28441 - DNA, 316 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 28442 - DNA, 350 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28443 - DNA, 290 bp, Artificial
  Mutation in BnaA.FAD2.a introduced by TALE nuclease pair BnFAD2_T03
caggatccatgggtgcaggtggaagaatgcaagtctctcctctcagagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28444 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccgaactcaagaaagcaatcccaccgcactgtttcaaacgctcgatccctcgctctttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgacta

SEQ ID NO: 28445 - DNA, 417 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtgggcctggcacagcaccggcaacagccgctggaccgtctccagcgcctgcttgccaccgccattagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28446 - DNA, 325 bp, Artificial
  Mutation in BnaA.FAD2.a introduced by TALE nuclease pair BnFAD2_T03
caggatccatgggtgcaggtggaagaatgcaagtgtctcctgcatccaaaaagactgaaaccgacaacatcaagcgcgtaccctgcgagacaccgcccttcactgtcactgtttcaaacgctcgatccctcgctctttctcctacctcatctgggacatcatcatatcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 28447 - DNA, 323 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28448 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28449 - DNA, 306 bp, Artificial
  Mutation in BnaA.FAD2.a introduced by TALE nuclease pair BnFAD2_T03
caggatccatgggtgcaggtgcaagaatgcaagtgtctcctccatccaagaagactgaaaccgacaccatcaagcgcgtaccctgcgagacaccgcccttcactcaagaaagcaatcccaccgcactgtttcaaacgctcgatccctcgctctttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 28450 - DNA, 318 bp, Artificial
  Mutation in BnaA.FAD2.a introduced by TALE nuclease pair BnFAD2_T03
caggatccatgggtgcaggtggaagaatgcaagtgtctcctccatccaaaaagcctgaaaccgacaacatcaagcgcgtaccctgcgagacaccgccctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28451 - DNA, 334 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 28452 - DNA, 309 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaaaccgacaacacccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28453 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28454 - DNA, 409 bp, Artificial
  Mutation in BnaA.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgttgcactgacgggtgccccgctcaacttgaccccccagcaggtggtggccatcgccagcaataatggtggcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28455 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcctctgggacatcatcatagcctcctgcttctactacgtcgccaccacctactcccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28456 - DNA, 350 bp, Artificial
  Mutation in BnaA.FAD2.a introduced by TALE nuclease pair BnFAD2_T03
caggatccatgggtgcaggtggaagaatgcaagtgtatccaccctccaaaaagcctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcctcgcctggcctctctactgggcctgccagggctgcctcctaagcggcgtctggggcgtatgccacgaggggggcccccacgccttcagggacttcc

SEQ ID NO: 28457 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgagtgcggccaccacgccttcagcgactac

SEQ ID NO: 28458 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28459 - DNA, 358 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccagggctgcgtcctaaccggcgtctgggtcatagcccacgagtgcggccaccacgccttcagcgactac

SEQ ID NO: 28460 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28461 - DNA, 350 bp, Artificial
  Mutation in BnaA.FAD2.a introduced by TALE nuclease pair BnFAD2_T03
caggatccatgggtgcaggtggaagaatgcaagtgtcccctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctctctactgggcctgccagggctgcgtcctaaccggcgtctgggtcatagcccacgagtgcggccaccacgccttcagcgactac

SEQ ID NO: 28462 - DNA, 344 bp, Artificial
  Mutation in BnaA.FAD2.a introduced by TALE nuclease pair BnFAD2_T03
caggatccatgggtgcaggtcgaagaatgcaagtgtcccctccatccaaaaagcctgaaaccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28463 - DNA, 353 bp, Artificial
  Mutation in BnaA.FAD2.a introduced by TALE nuclease pair BnFAD2_T03
caggtccatgggtgcaggtggaagaatgcaagtgtatcctccctccaagaagtctgaaaacgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28464 - DNA, 350 bp, Artificial
  Mutation in BnaA.FAD2.a introduced by TALE nuclease pair BnFAD2_T03
caggatccatgggtgcaggtggaagaatgcaagtgccacctacctacaagaagcctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccctcagcgactac

SEQ ID NO: 28465 - DNA, 349 bp, Artificial
  Mutation in BnaA.FAD2.a introduced by TALE nuclease pair BnFAD2_T03
caggatccatgggtgcaggtggaagaatgcaagtgtctcctccctcccaaaagtctgaaaccgacaacatcaagcgcgtaccctgcgagacaccgcccttcactgagaactcaagatagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgagccggccagggctgcgtcctagccggcgtctgggtcatagcccacgattgcggccaccgcgccatcagcgactac

SEQ ID NO: 28466 - DNA, 336 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtcgaactcaagaaagcaatcccaccgcactgtttcaaacgctccatcccacgctccttctcctcttcgacatcatcatctcctcctcggctcctccctctcccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28467 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgcctgggctgcgtcctaaccggcgtctgggtcatagcccacgagtgcggccaccacgccttcagcgactac

SEQ ID NO: 28468 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28469 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28470 - DNA, 351 bp, Artificial
  Mutation in BnaA.FAD2.a introduced by TALE nuclease pair BnFAD2_T03
caggatccatgggtgcaggtgaaagaatgcaagtgtctcatccctccaaaaagtctgaaaccgacaacatcaagcgcgtaccctgcgagccaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgcgcctgccagggctgcgtcctaaccggcgtctgggtcatagcccacgagtgcggccaccacgccttcagcgactac

SEQ ID NO: 28471 - DNA, 337 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaagaaagctatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28472 - DNA, 411 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcctggcacagcaccggcaacagccgctggaccgtctccagcgcctgcttgccaccattagaactcaagaaagcaatcccaccgctctgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28473 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcgaccaccacgccttcagcgactac

SEQ ID NO: 28474 - DNA, 348 bp, Artificial
  Mutation in BnaA.FAD2.a introduced by TALE nuclease pair BnFAD2_T03
caggatccatgggtgcaggtggaagaatgcaagtgtatcatccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28475 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 28476 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccaagccttcagcgactac

SEQ ID NO: 28477 - DNA, 400 bp, Artificial
  Mutation in BnaA.FAD2.a introduced by TALE nuclease pair BnFAD2_T03
caggatccatggtgcaggtggaagaatgcaagtgtctcctccctccaaaaagtctgaaaccgacaacatcaagcgcgtaccctgcgagacaccgcccttcactgttgcccgccaccctccgggccgttgcttcacaacgttcaaatccgctcccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28478 - DNA, 357 bp, Artificial
  Mutation in BnaA.FAD2.a introduced by TALE nuclease pair BnFAD2_T03
caggatccatgggtgcaggtggaagaatgctagtgtctcctccctccaaaaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccatgagtgcggccaccacgccttcagcgactac

SEQ ID NO: 28479 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgaaccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28480 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacctccctccaagtgtctcctccctcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 28481 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 28482 - DNA, 287 bp, Artificial
  Mutation in BnaA.FAD2.a introduced by TALE nuclease pair BnFAD2_T03
caggatccatgggtgcaggtggaagaatgcaagtgtcacctccctccaagaagtctgaaaccgacaccatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28483 - DNA, 351 bp, Artificial
  Mutation in BnaA.FAD2.a introduced by TALE nuclease pair BnFAD2_T03
caggatccatgggtgcaggtggaagaatgcaagtgcctcctccctccaaaaagactgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28484 - DNA, 404 bp, Artificial
  Mutation in BnaA.FAD2.a introduced by TALE nuclease pair BnFAD2_T03
caggatccatgggtgcaggttgaagaatgcaagtgtccccaccctccaaaaagactgaaaccgacaacatcaagcgcgtaccctgcgagacaccgcccttcactgtcgtctccagcgcctgcttgccgccatcgtggctggcgatggccaccacctgctccggacccaagaaagcaatcccaccgcactgtttcaaacgctcgatccctcgctctttctcctaccccatctgggacatcatcatagcctcctgcttctactacgtcgccaccacttacttccctctccgccctcaccctctctcctacttcgcctggcctctctactgggcctgccagggctgcgtcctaaccggcgtctgggtcatagcccgcgagtgcggccaccacgccttcagcgactac

SEQ ID NO: 28485 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctacgagacaccgcccttcactgtcgggagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28486 - DNA, 423 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggcgatggccaccacctgctccggggtcaagccgtgggcctggcacagcaccggcaacagccgctggagactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28487 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 28488 - DNA, 344 bp, Artificial
  Mutation in BnaA.FAD2.a introduced by TALE nuclease pair BnFAD2_T03
caggatccatgggtgtaggtggaagaatgcaagtgtctcctccctccaaaaagtctgaaaccgacaacatcaagcgcgtaccctgcgagacaccgcccttcacactcacgaaagcaatcccacctcactgcttcaaacgctccatccctcgcactttctcctacctcatctgggacatcatcatagcctcctgcttctactacgtcgccaccacttacttccctctcctccctcaccctctctcctgcttcgcctggcctctctactgggcctgccaaacgtgcgtcctaaccggcgtctgggtcatagcccacaagtgcggccaccacgccttcagcgactac

SEQ ID NO: 28489 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28490 - DNA, 339 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28491 - DNA, 338 bp, Artificial
  Mutation in BnaA.FAD2.a introduced by TALE nuclease pair BnFAD2_T03
caggatccatgggtgcatgtggaagaatgcaagtgtctcctccctccaagaagtctgaaaccaacaccatcaagcgcgtaccctgcgagacaccgcccttcactaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28492 - DNA, 318 bp, Artificial
  Mutation in BnaA.FAD2.a introduced by TALE nuclease pair BnFAD2_T03
caggatccatgggtgcaggcggaagaatgcaagtgtctcctccctccaaaaagactgaaaccgacaacatcaagcgcgtaccctgcgagacaccgccctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28493 - DNA, 333 bp, Artificial
  Mutation in BnaA.FAD2.a introduced by TALE nuclease pair BnFAD2_T03
caggatccatgggtgcaggtggaagaatgcaagtgtctcctccatacaaaaagactgaaaccgacaacatcaagcgcgtaccctgcgagacaccgcccttcactgtactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctcttggtcatagcccacgagtgcggccaccacgccttcagcgactac

SEQ ID NO: 28494 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28495 - DNA, 344 bp, Artificial
  Mutation in BnaA.FAD2.a introduced by TALE nuclease pair BnFAD2_T03
caggatccatgggtgcaggtggaagaatgcaagtgtcccctccctccaaaaagtctgaacccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggggcatagcccacgagtgcggccaccacgccttcagcgactac

SEQ ID NO: 28496 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtccgaaaccgacaacatcaagcgcgtaccctgcgagacaccgcccttcactgtccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28497 - DNA, 337 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcaatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28498 - DNA, 350 bp, Artificial
  Mutation in BnaA.FAD2.a introduced by TALE nuclease pair BnFAD2_T03
caggatccatgggtgcaggtggaagaatgcaagtgcctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28499 - DNA, 340 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccaactcaagaaagcaatcccaccgcactgtttcaaacgctcgcttcctcggtctttctcctacctcctctgcctcttcctcatagcctcctccttctactacgtcgccaccacctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28500 - DNA, 356 bp, Artificial
  Mutation in BnaA.FAD2.a introduced by TALE nuclease pair BnFAD2_T03
caggatccatgagtgcaggtggaagaatgcaagtgtaacctacctccaagaagactgaaaacgacaccatcaagcgcgtaccctgcgagacaccgcccttcactttgctccaagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcgcctacttcgcctggcctctctactgggcctgccagggctgcgtcctagcgggcctctgggtcatagcccacgagtgcggccaccacgccatcagcgactac

SEQ ID NO: 28501 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28502 - DNA, 367 bp, Artificial
  Mutation in BnaA.FAD2.a introduced by TALE nuclease pair BnFAD2_T03
caggatcccatgggtgcaggcggaagaatgcaagtctatcctccctccagctcccccgaaaccaaaaccctcaaacgcgtcccctgcgagacaccacccttcactgattataagttacttactagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccgcgagtgcggcgaccacgccttcagcgactac

SEQ ID NO: 28503 - DNA, 350 bp, Artificial
  Mutation in BnaA.FAD2.a introduced by TALE nuclease pair BnFAD2_T03
caggatccatgggtgcaggtggaagaatgcaagtctctcctccctccaagtaccctgaaaccaacaccatcaagcgcgtcccctgcgagacaccgcccttcactgtagaactcaacaaagcaatcccaccgcaccgcttctaacgctcgatccctcgctctttctcctccctcatctgggacatcatcctaccctcctgcttccactacgtcgcccccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28504 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagactgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28505 - DNA, 350 bp, Artificial
  Mutation in BnaA.FAD2.a introduced by TALE nuclease pair BnFAD2_T03
caggatccatgggtgcaggtcgaagaatgcaagtgtcccctccatccaaaaagcctgaaaccgacaacatcaagcgcgtaccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28506 - DNA, 382 bp, Artificial
  Mutation in BnaA.FAD2.a introduced by TALE nuclease pair BnFAD2_T03
caggatccatgggtgcaggttgaagaatgcaagtgtctcctccctccaaaaagtctgaaaccgacaacatcaagcgcgtaccctgcgagacaccgcccttcactgtacagccgctggaccgtctccagcgcctgtcggagaactcaagaaagcaatcccaccgcactgtttcaaacgctcgatccctcgctctttctcctacctcatctgggacatcatcatagcctcctgcttctactacgtcgccaccacttacttccctctcctccctctccctctctcctccttcgcctggcctctctactgggcctgccaagggtgcgtcctagccggcgtctgggtcatagcccacgagtgcggccaccacgccttcagcgactac

SEQ ID NO: 28507 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactgacctcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatagcccacgagtgcggccaccacgccttcagcgactac

SEQ ID NO: 28508 - DNA, 325 bp, Artificial
  Mutation in BnaA.FAD2.a introduced by TALE nuclease pair BnFAD2_T03
caggatccatgggtgcaggtggaagaatgcaagtgtctcctgcctccaaaaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28509 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactgagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctagcctctctactgggcctgccaagggtgcgtcctaaccggcgtctgggtcatagcccacgagtgcggccaccacgccttcagcgactac

SEQ ID NO: 28510 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcttcctaaccggcgtctgggtcatagcccacgagtgcggccaccacgccttcagcgactac

SEQ ID NO: 28511 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 28512 - DNA, 340 bp, Artificial
  Mutation in BnaA.FAD2.a introduced by TALE nuclease pair BnFAD2_T03
caggatccatgggtgcaggcggaagaatgcaagtgactcctccctccaaaaagcctgaaaccgacaacatcaagcgcgtaccctgcgagacaccgcccaactcaagaaagcaatcccaccgcactgtttcaaccgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28513 - DNA, 348 bp, Artificial
  Mutation in BnaA.FAD2.a introduced by TALE nuclease pair BnFAD2_T03
caggatccatgggtgcaggtgcaagaatgcaagtgtctcctccatccaaaaagtctgaaaccgacaacatcaagcgcgtaccctgcgagacaccgcccttcacttgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28514 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28515 - DNA, 350 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaaccggcgtctgggtcatagcccacgagtgcggccaccacgccttcagcgactac

SEQ ID NO: 28516 - DNA, 306 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28517 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgtgagacaccgcccttcactgtagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28518 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaacgcctggaaccgacaacatcaagcgcgtcccctgcgagacactgccgacggtctcgatccctcactctatctcctacctcatctgggacatcatcatagcctcctccttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 28519 - DNA, 336 bp, Artificial
  Mutation in BnaA.FAD2.a introduced by TALE nuclease pair BnFAD2_T03
caggatccatgggtgcaggtggaagaatgcaagtgtaacctccctccaaaaagtctgaaaccgacaacatcaagcgcgtaccctgcgagacaccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28520 - DNA, 351 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28521 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28522 - DNA, 349 bp, Artificial
  Mutation in BnaA.FAD2.a introduced by TALE nuclease pair BnFAD2_T03
caggatccatgggtgcaggtcgaagaatgcaagtgtctcctccacccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcaccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28523 - DNA, 350 bp, Artificial
  Mutation in BnaA.FAD2.a introduced by TALE nuclease pair BnFAD2_T03
caggatccatgggtgcaggtggaagaatgcaagtgtttcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcctcgtctcctcctccctctaccacctctccacagcctacttccctctcctcccccaccctctcccttacctcgcctggcccctctactgggcctgccaaggctgcgtcctaactggcctctgggtcatcgcccacgaattctgccaccgcgccatcagcgactac

SEQ ID NO: 28524 - DNA, 329 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 28525 - DNA, 283 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 28526 - DNA, 347 bp, Artificial
  Mutation in BnaA.FAD2.a introduced by TALE nuclease pair BnFAD2_T03
caggatccatgggtgcaggtggaagaatgcaagtgactcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28527 - DNA, 318 bp, Artificial
  Mutation in BnaA.FAD2.a introduced by TALE nuclease pair BnFAD2_T03
caggatccatgggtgcaggtggaagaatgcaagtgactcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcacgactac

SEQ ID NO: 28528 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacctcaagcgcgtaccctgcgagacaccgcccttcactgtaggactcaagaaagcaatcccaccgcactgtttcaaacgctctatccctcgctctttctcctacctcatctgggacataatcatagcctcctgcttctcctacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28529 - DNA, 402 bp, Artificial
  Mutation in BnaA.FAD2.a introduced by TALE nuclease pair BnFAD2_T03
caggatccatgggtgcaggtggaagaatgcaagtgtctcccccatccaaaaagcctgaaaccgacaacatcaagcgcgtaccctgcgagacaccgcccttcactgtccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgtcagggctgcgtcctaaccggcgtctgggtcatagcccacgagtgcggccaccacgccttcagcgactac

SEQ ID NO: 28530 - DNA, 351 bp, Artificial
  Mutation in BnaA.FAD2.a introduced by TALE nuclease pair BnFAD2_T03
caggatccatgggtgcaggtgcaagaatgcaagtgtctcctcccaccaagaagtctgaaaccgacaccatcaagcgcgtaccctgcgagccaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatctcccacgaatgcggcctccacgccatcagcgactac

SEQ ID NO: 28531 - DNA, 350 bp, Artificial
  Mutation in BnaA.FAD2.a introduced by TALE nuclease pair BnFAD2_T03
caggatccatgggtgcaggtggaagaatgcaagtgcctcctccctccaaaaagactgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatatcccgcgagtgctgtgaccacgccttcagcgactac

SEQ ID NO: 28532 - DNA, 319 bp, Artificial
  Mutation in BnaA.FAD2.a introduced by TALE nuclease pair BnFAD2_T03
caggatccatgggtgcaggtggaagaatgcaagtgtctcctccacccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctctccctctctcctacttcgcctggcctctctactgggcctgccagggctgcgtcctaaccggcgtctggttcatagcccacgagtgcggccaccacgccatcagcgactac

SEQ ID NO: 28533 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 28534 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccctgcgagacaccgcccttcactgttagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28535 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 28536 - DNA, 344 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28537 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcttcctaacgggcctctgggtcatcgcccacgaatgcggccaccacgccttcagcgactac

SEQ ID NO: 28538 - DNA, 402 bp, Artificial
  Mutation in BnaA.FAD2.a introduced by TALE nuclease pair BnFAD2_T03
caggatccatgggtgcaggtggaagaatgcaagtgactcatccctcccaaaagtctgaaaccgacaacatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 28539 - DNA, 347 bp, Artificial
  Mutation in BnaA.FAD2.a introduced by TALE nuclease pair BnFAD2_T03
caggatccatgggtgcaggtggaagaatgcaagtgtctcctccctacaaaaagtctgaaaccgacaacatcaagcgcgtaccctgcgagacaccgcccttcaaagaactcaagaaagcaatcccaccgcactgtttcaaacgctcgatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28540 - DNA, 382 bp, Artificial
  Mutation in BnaA.FAD2.a introduced by TALE nuclease pair BnFAD2_T03
caggatccatgggtgcaggtgaaagaatgcaagtgactccaccctccaagaagtctgaaaccgacaccatcaagcgcgtaccctgcgagacaccgcccttcactgtgatagttgagtcgatacttcggcgatcaccgctgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28541 - DNA, 346 bp, Artificial
  Mutation in BnaA.FAD2.a introduced by TALE nuclease pair BnFAD2_T03
caggatccatgggtgcaggtggaagaatgcaagtgtcacctacctccaagaagtctgaaaccgacaccatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcatcgactac

SEQ ID NO: 28542 - DNA, 373 bp, Artificial
  Mutation in BnaA.FAD2.a introduced by TALE nuclease pair BnFAD2_T03
caggatccatgggtgcaggtggaagaatgcaagtgtcgcgtccctccaaaaagtctgaaaccgacaacatcaagcgcgtaccctgcgagacactgccaggcatcaaactaagcagaaggccatccgtcaaacgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 28543 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgattgtagaactcaagaaagcaatcccaccgcactgtttctaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 28544 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttgcctctctactgcgcctgccaagggtgcgtcctaaccggcgtctgggtcatagcccacgagtgcggccaccacgccttcagcgactac

SEQ ID NO: 28545 - DNA, 346 bp, Artificial
  Mutation in BnaA.FAD2.a introduced by TALE nuclease pair BnFAD2_T03
caggatccatgggtgcaggtggaagaatgcaagtctctcccccctccagctcccccgaaaccaaaaccctcaaacgcgtcccctgcgagacaccacccttcactacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28546 - DNA, 347 bp, Artificial
  Mutation in BnaA.FAD2.a introduced by TALE nuclease pair BnFAD2_T03
caggatccatgggtgcaggtggaagaatgcaagtgtctcctccctcccaaaagactgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgcgcctgccagggctgcgtcctaaccggcgtctgggtcatagcccacgagtgcggccaccacgccttcagcgactac

SEQ ID NO: 28547 - DNA, 416 bp, Artificial
  Mutation in BnaA.FAD2.a introduced by TALE nuclease pair BnFAD2_T03
caggatccatgggtgcagggggaagaatgcaagtgtctcctccctccaaaaagactgaaaccgacaccatcaagcgcgtaccctgcgagacaccgcccttcactgcccacggcttgaccccggagcaggtggtggccatcgccagccacgatggcggcaagcaggcgctggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28548 - DNA, 370 bp, Artificial
  Mutation in BnaA.FAD2.a introduced by TALE nuclease pair BnFAD2_T03
caggatccatgggtgcaggtggaagaatgcaagtgtcacatccctccaaaaagtctgaaaccgacaacatcaagcgcgtaccctgcgagacaccgcccttcactgtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28549 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaaggctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggggcatagcccacgagtgcggccaccacgccttcagcgactac

SEQ ID NO: 28550 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgagcctgccagggctgcgtcctaaccggcgtctgggtcatagcccacgagtgcggccaccacgccttcagcgactac

SEQ ID NO: 28551 - DNA, 317 bp, Artificial
  Mutation in BnaA.FAD2.a introduced by TALE nuclease pair BnFAD2_T03
caggatccatgggtgcaggcggaagaatgcaagtgcctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccactagtgcggccaccacgccttcagcgactac

SEQ ID NO: 28552 - DNA, 351 bp, Artificial
  Mutation in BnaA.FAD2.a introduced by TALE nuclease pair BnFAD2_T03
caggatccatgggtgcaggtggaagaatgcaagtgtcacctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28553 - DNA, 304 bp, Artificial
  Mutation in BnaA.FAD2.a introduced by TALE nuclease pair BnFAD2_T03
caggatccatgggtgcaggtggaagaatgcaagtgtctcctccctcccaaaagtctgaaaccgacaacatcaagcaatcccaccgcactgtttcaaacgcttgatccctcgctctttctcctacctcatctgggacatcatcatagcctcctgcttctactacgtcgccaccacttacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 28554 - DNA, 394 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgccggtgctgtgccaggcccacggcttgaccccccagcaggtggtgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28555 - DNA, 350 bp, Artificial
  Mutation in BnaA.FAD2.a introduced by TALE nuclease pair BnFAD2_T03
caggatccatgggtgcaggtgcaagaatgcaagtgtctcctccctccaaaaagcctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 28556 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggtctgccagggctgcgtcctaaccggcgtctgggtcatagcccacgagtgcggccaccacgccttcagcgactac

SEQ ID NO: 28557 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgtgtcatagcccacgagtgcggccaccacgccttcagcgactac

SEQ ID NO: 28558 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaacgggcctctgggtcatagcccacgagtgcggccaccacgccttcagcgactac

SEQ ID NO: 28559 - DNA, 359 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctggcctctctactgggcctgccagggctgcgtcctaaccggcgtctgggtcatagcccacgagtgcggccaccacgccttagcgactac

SEQ ID NO: 28560 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28561 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 28562 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 28563 - DNA, 412 bp, Artificial
  Mutation in BnaA.FAD2.a introduced by TALE nuclease pair BnFAD2_T03
caggatccatgggtgcaggtggaagaatgcaagtgtctcctccctccaagaagactgaaaccgacaccatcaagcgcgtaccctgcgagacaccgcccttcactgacggatggcctttttgcgtttctacaacctcttcctggctagcggaacgcgtattaattgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28564 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28565 - DNA, 415 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcccacggcttgaccccggagcaggtggtggccatcgccagccacgatggcggcaacagccgctggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28566 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagccataaaccgacaacatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactacgtcgcctccacttacttccctctcctcccccaccctctcccttacctcgcctggcccctctactgggcctgccaaggctgcgtcctaacgtgcctctgggtcatcgcccacgaatgcggccaccacgccttcagcgactac

SEQ ID NO: 28567 - DNA, 350 bp, Artificial
  Mutation in BnaA.FAD2.a introduced by TALE nuclease pair BnFAD2_T03
caggatccatgggtgcaggtgaaagaatgcaagtgtcacctcccaccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28568 - DNA, 308 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 28569 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccccgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28570 - DNA, 347 bp, Artificial
  Mutation in BnaA.FAD2.a introduced by TALE nuclease pair BnFAD2_T03
caggatccatgggtgcaggtggaagaatgcaagtgtctcctacctccaagaagcctgaaaccgacaccatcaagcgcgtaccctgcgagacaccacccttcactcaactcaagaaagcaatcccaccgcactgtttcaaacgctcgatccctcgctcttgctcctacctcatctgggacatcatcatagcctcctgcttctactacgtcgccaccacctacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28571 - DNA, 346 bp, Artificial
  Mutation in BnaA.FAD2.a introduced by TALE nuclease pair BnFAD2_T03
caggatccatgggtgcagggggaagaatgcaagtctctcatccctccagctcccccgaaaccaaaaccctcaaacgcgtcccctgcgagacaccacccttcactacctcaagaaagcaatcccaccgcactgtttcaaacgctcgatccctcgctctttctcctacctcatctgggacatcatcatagcctcctgcttctactacggcgccaccacttacttccctctcctccctcaccctctctcctacttcgcctagcctctctactgggcctgccagggctgcgtccgaaccggcgtctgggtcatagcccacgagtgcggccaccgcgccatcagcgactac

SEQ ID NO: 28572 - DNA, 345 bp, Artificial
  Mutation in BnaA.FAD2.a introduced by TALE nuclease pair BnFAD2_T03
caggatccatgggtgcaggtggaagaatgcaagtgtcacctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28573 - DNA, 344 bp, Artificial
  Mutation in BnaA.FAD2.a introduced by TALE nuclease pair BnFAD2_T03
caggatccatgggtgcaggtggaagaatgcaagtctctcctccatcccgctcccccggaaccaacaccctcaaacgcgtcccctgcgagacaccaccattcaccctcaagaaagcaatcccaccgcactctttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28574 - DNA, 295 bp, Artificial
  Mutation in BnaA.FAD2.a introduced by TALE nuclease pair BnFAD2_T03
caggatccatgggtgcaggtggaagaatgcaagtgtctccttcctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccatcagcgactac

SEQ ID NO: 28575 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacagacctcaagaaagcaatcccacctcactgcttcaaacgctcgatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28576 - DNA, 344 bp, Artificial
  Mutation in BnaA.FAD2.a introduced by TALE nuclease pair BnFAD2_T03
caggatccatgggtgcaggtggaagaatgcaagtgtatcatccctccaaaaagtctgaaaccgacaacatcaagcgcgtaccctgcgagacaccgcccttcacactcaagaaagcaatcccaccgcactgtttcaaacgctcgatccctcgctcgttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28577 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgctgccaccacgccttcagcgactac

SEQ ID NO: 28578 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 28579 - DNA, 351 bp, Artificial
  Mutation in BnaA.FAD2.a introduced by TALE nuclease pair BnFAD2_T03
caggatccatggggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28580 - DNA, 349 bp, Artificial
  Mutation in BnaA.FAD2.a introduced by TALE nuclease pair BnFAD2_T03
caggatccatgagtgcaggtggaagaatgcaagtgtctcatacctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctctctactgggcctgccagggctgcgtcctaaccggcgtctgggtcatagcccacgagtgcggccaccacgccttcagcgactac

SEQ ID NO: 28581 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctggcctctctactgggcctgccaagggtgcgtcctaaccggcgtctgggtcatagcccacgagtgcgtccaccacgcctgcagcgacta

SEQ ID NO: 28582 - DNA, 317 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtcaaacgctcgatccctccctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28583 - DNA, 355 bp, Artificial
  Mutation in BnaA.FAD2.a introduced by TALE nuclease pair BnFAD2_T03
caggatccatggtgcaggtggcagaatgcaagtgtctcctccctccaaaaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28584 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 28585 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaacgacaacatcaagcgcgtaccctgcgcgacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28586 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28587 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcacgacctcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctgacccctctactgggcctgccaaggctgcgtcctaaccggcgtctgggtcatagcccacgagtgcggccaccacgccttcagcgactac

SEQ ID NO: 28588 - DNA, 341 bp, Artificial
  Mutation in BnaA.FAD2.a introduced by TALE nuclease pair BnFAD2_T03
caggatccatgggtgcagggggaagaatgcaagtgtctcctcccccccagaagtctgaaaccgacacaatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagtgctgcgtcctaaccggcgtctgggtcatagcccacgagtgcggccaccacgccttcatcgactac

SEQ ID NO: 28589 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgtcttcagcgactac

SEQ ID NO: 28590 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 28591 - DNA, 409 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccccctggcttgaccccggagcaggtggtggccatcgccagccacgatggcggcaccagccgctggaccgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28592 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaaccggatcaaagagttcctccgccgctggacctaccaaggcaacgctatgttctaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28593 - DNA, 325 bp, Artificial
  Mutation in BnaA.FAD2.a introduced by TALE nuclease pair BnFAD2_T03
caggatccatgggtgcagttggaagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28594 - DNA, 326 bp, Artificial
  Mutation in BnaA.FAD2.a introduced by TALE nuclease pair BnFAD2_T03
caggatccatgggtgcaggtggaagaatgcaagtctctcctccctcccgctcccccgaaaccaaaaccctcaaacgcgtcccctgcgagacaccacccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccagggctgcgtcctaaccggcgtctgggtcagagcccacgagtgcggccaccacgccttcagcgactac

SEQ ID NO: 28595 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 28596 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttcttccaccgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28597 - DNA, 359 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28598 - DNA, 350 bp, Artificial
  Mutation in BnaA.FAD2.a introduced by TALE nuclease pair BnFAD2_T03
caggatccatgggtgcaggtggaagaatgcaagtgtctcctgccccccaaaagtctgaaaccgacaacatcaagcgcgtaccctgcgcgacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccagggctgcgtcctaaccggcgtctgggtcatagcccacgagtgcggccaccacgccttcagcgactac

SEQ ID NO: 28599 - DNA, 408 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgcgtcgatccactgagcgtcagaactccggggtcaagccgtgggcctggcacagcaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28600 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccatcagcgactac

SEQ ID NO: 28601 - DNA, 343 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28602 - DNA, 334 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 28603 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctcttcgacatcatcatctcctcctcggctcctccctctcccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 28604 - DNA, 372 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccaaaaccctcaaacgcgtcccctgcgagacaccacccttcactctcagcggctgttgccggtgctgtgccaggcccccgctcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgcgcctgccagggctgcgtcctaaccggcgtctgggtcatagcccacgagtgcggccaccacgccttcagcgactac

SEQ ID NO: 28605 - DNA, 342 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28606 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 28607 - DNA, 428 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatgaagcgcgtaccctgcgagacaccgcccttcactgtcggtgctgtgccaggcccacggcttgaccccccagcaggtggtggccatcgccagcaataatggcggcaagcaggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28608 - DNA, 350 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagcgcgtaccctgcgagacaccgcccttcactgtagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28609 - DNA, 410 bp, Artificial
  Mutation in BnaA.FAD2.a introduced by TALE nuclease pair BnFAD2_T03
caggatccatgggtgcagggggaagaatgcaagtctctcctccctccagctcccccggaaccaacaccatcaagcgagtaccctgagagacaccgcccttcactgtcgactcaagacgatagttaccggataaggcgcagcggtcgggctgaacggggggtggaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28610 - DNA, 345 bp, Artificial
  Mutation in BnaA.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgtacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28611 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcccttacctcgcctggcccctctactgggcctgccaaggctgcgtcctaacgggcctctgggtcatcgcccacgaatgcggccaccacgccttcagcgactac

SEQ ID NO: 28612 - DNA, 342 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28613 - DNA, 350 bp, Artificial
  Mutation in BnaA.FAD2.a introduced by TALE nuclease pair BnFAD2_T03
caggatccatgggtgcaggtagaagaatgcaagtgtctcctccctccaagaagactgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcttctgggtcatagcccacgagtgcggccaccacgccttcagcgactac

SEQ ID NO: 28614 - DNA, 349 bp, Artificial
  Mutation in BnaA.FAD2.a introduced by TALE nuclease pair BnFAD2_T03
caggatccatgggtgcagggggaagaatgcaagtgtctcctccctccaaaaagtctgaaaccgacaacatcaagcgcgtaccctgcgagacaccgcccttcactgagaaagcaagaaagcaatcccaccgcactgtttcaaacgctcgatccctcgctctttctcctacctcagctgggacatcatcatagcctcctgcttctactacgtcgccaccacttacttccctctccttcctcaccctctctcctacttcgcctggcctctctactgggcctgccagggctgcttcctaaccggcgtctggggcatagcccacgagtgcggcgaccacgccttcatcgactac

SEQ ID NO: 28615 - DNA, 348 bp, Artificial
  Mutation in BnaA.FAD2.a introduced by TALE nuclease pair BnFAD2_T03
caggatccatgggtgcaggtggaagaatccaagtgtctcctccctccaagaagtctgaaaccgacaccatcaagcgcgtaccctgcgagacgccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggggcatagcccacgagtgcggcctccacgccttcagcgactac

SEQ ID NO: 28616 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 28617 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacctcaagcgcgtaccctgcgagacaccgcccttcactgtcggaactcaagaaagcaatcccaccgcactgtttcaaacgctccatccctcgctctttctcctacctcatctgtgacatcatcatagcctcctgcctctaatacgtcgccaccacttacttccctctcctcccccaccctctctcctacttcgcctggcctctctactgggcctgccaagggtgcgtcctaacgggcgtctgggtcatagcccacgagtgcggccaccacgccttcagcgactac

SEQ ID NO: 28618 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcagggctgcgtcctaaccggcgtctgggtcatagcccacgagtgcggccaccacgccttcagcgactac

SEQ ID NO: 28619 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28620 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcctccgaaaccaaaaccctcaaacgcgtcccctgcgagacaccacccttcactctgtcaagaaagcaatcccaccgcactgtgtcaaactctcgatccctcgctctttcgcctacctcatctgggacatcatcatagcctcctgcttctactacgtcgccaccacttacttccctctcctccctcaccctctctccttcttcgcctggcctctctactgggcctgccagggctgcgtcctaaccggcgtctgggtcatagcccacgagtgcggccaccacgccttcatcgactac

SEQ ID NO: 28621 - DNA, 324 bp, Artificial
  Mutation in BnaA.FAD2.a introduced by TALE nuclease pair BnFAD2_T03
caggatccatgggtgcagggagaagaatgcaagtgtttcctccctcccaaaagtctgaaaccgacaaaatcaaccgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcatcgactac

SEQ ID NO: 28622 - DNA, 347 bp, Artificial
  Mutation in BnaA.FAD2.a introduced by TALE nuclease pair BnFAD2_T03
caggatccatgggtgcaggtggaagaatgcaagtgtctcctccctacaaaaagtctgaaaccgacaacatcaagcgcgtaccctgcgagacaccgcccttcactgtactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28623 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacattaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28624 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 28625 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactccagaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28626 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 28627 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtcttaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28628 - DNA, 392 bp, Artificial
  Mutation in BnaA.FAD2.a introduced by TALE nuclease pair BnFAD2_T03
caggatccatgggtgcaggtggaagaatgcaagtgtctcctccctccaagaagactgaaaccgacaccatcaagcgcgtaccctgcgagacaccgccattcactctcgccggcttgccacaaccattgctggcgatgtgcaccaccttttacctcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 28629 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggtcctgccagggctgcgtcctaaccggcgtctgggtcatagcccacgagtgcggccaccacgccttcagcaactac

SEQ ID NO: 28630 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccacctcactgcttcaaacgctccatccctcgctccttctcctacctcatctgggacatcatcatagcctcctgcttcttctacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28631 - DNA, 430 bp, Artificial
  Mutation in BnaA.FAD2.a introduced by TALE nuclease pair BnFAD2_T03
caggatccatgggtgcaggtggaagaatgcaagtgtcacacccctccaaaaagtctgaaaccgacaacatcaaacgcgtaccctgcgaaacaccgcccttccatttggtacaccgccctacaccgcccttcacacgcccgccataaactgccaggcatcaaactaagcagaaggccatcctgacggagaactcaagaaagcaatcccaccgcactgtttcaaacgctcgatccctcgctctttctcctacctcatctgggacatcatcatagcctcctgcttctactacgtcgccaccacttacttccctctccgccctcaccctctctcctgcttcgcctggcctctctactgggcctgccaagggtgcgtcctaaccggcgtctgggtcatagcccacgagtgcggccaccacgccatcagcgactac

SEQ ID NO: 28632 - DNA, 346 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28633 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtacaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctgacccctctactgggcctgccagggctgcgtcctaaccggcgtctgggtcatagcccacgagtgcggccaccacgccttcagcgactac

SEQ ID NO: 28634 - DNA, 374 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactccagaaacccgcggctgagtggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28635 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28636 - DNA, 345 bp, Artificial
  Mutation in BnaA.FAD2.a introduced by TALE nuclease pair BnFAD2_T03
caggatccatgggtgcaggtggaagaatgcaagtgtctcatccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28637 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccattaagccacgatggcggcaagcaggcgctggagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 28638 - DNA, 408 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcgtcgttccactgagcgtcagaactccggggtcaagccgtgggcctggcacagcaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 28639 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgaccac

SEQ ID NO: 28640 - DNA, 277 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggtctctctactgggcctgccagggctgcgtcctaaccggcgtctgggtcatagcccacgagtgcggccaccacgccttcagcgactac

SEQ ID NO: 28641 - DNA, 316 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctccaatatttaccttccctccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28642 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 28643 - DNA, 303 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctccatcccacgctccttctcctcttcgacatcatcatctcctcccccaccctctcccttacctcgcctggcccctctactgggcctgccaaggctgcgtcctaacgggcctctgggtcatcgcccacgaatgcggccaccacgccttcagcgactac

SEQ ID NO: 28644 - DNA, 403 bp, Artificial
  Mutation in BnaA.FAD2.a introduced by TALE nuclease pair BnFAD2_T03
caggaatccatgggtgcaggtggaagaatgcaagtgtctcctccctccaagaagtctgaaaccgacaccatcaagcgcgtaccctgcgagacaccgcccttcactgtcgaaccttcggtttgatcttctcctgttgctcggctatgtgccaggccatgctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctcaactgggcctgccagggctgcgtcctaaccggcctctgggtcatcgcccacgaatgcggccaccacgcttcagcgactac

SEQ ID NO: 28645 - DNA, 343 bp, Artificial
  Mutation in BnaA.FAD2.a introduced by TALE nuclease pair BnFAD2_T03
caggatccatgggtgcaggtggaagaatgcaagtctctcccccctccagctcccccggaaccaacaccctcaaacgcgtcccctgcgagacaccaccatagaactcaagaaagcaatcccaccgcactgtttcaaacgctcgatccctcgctctttctcctacctcatctgggacatcatcatagcctcctgcttctactacgttgccaccacttacttccctctcctccctcaccctctctcctacttcgcctggcctctctactgggcctgccagggctgcgtcctaaccggcgtcggggtcattgcccacgagtgcggccaccacgccttcatcgactac

SEQ ID NO: 28646 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgaaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28647 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 28648 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28649 - DNA, 403 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcggctgttgccgccatcgtggctggcgatggccaccacctgctccggagaactcaagaaagcaatcccaccgcactgtttcaaactctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28650 - DNA, 349 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28651 - DNA, 347 bp, Artificial
  Mutation in BnaA.FAD2.a introduced by TALE nuclease pair BnFAD2_T03
caggatccatgggtgcaggtggaagaatgcaagtgtcacctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28652 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 28653 - DNA, 416 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcccacggcttgaccccggagcaggtggtggccatcgccagccacgatggcggcaagcaggcgctggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28654 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccctcaagcgcgtaccctgcgagacaccgcccttcactgttagggacctcgcgaatgcatctcgatccaatgatcatgaacggagcattacggagaactcaagaaagcaatcccaccacactgtttcaaactctcgatccctcgctctttctcctacctcacctgggacatcatcatagcctcctgcttctactacgtcgccaccactcacttccctcccctcccccaccctctctcctacttcgcctggcccctctactgggcctgccagggctgcgtcctaaccggcgtctgggtcatagcccacgagtgcggccaccacgccttcagcgactac

SEQ ID NO: 28655 - DNA, 392 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccatgcgagacaccgcccttcactgtcgtaatctggaacatcgtatgggtaatcgatgaccttacgtttaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28656 - DNA, 349 bp, Artificial
  Mutation in BnaA.FAD2.a introduced by TALE nuclease pair BnFAD2_T03
caggatccatgggtgcaggtggaagaatgcaagtgtctcctccctccaacaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgcctccacttacttccctctcctccctcaccctctctccaacttcgcctggcctctctactgggcctgccaaggctgcgtcctaaccggcgtctgggtcatagcccacgagtgcggccaccacgccttcagcgactac

SEQ ID NO: 28657 - DNA, 377 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctcttctgggcctgccagggctgcgtcctaaccggcgtctgggtcatagcccacgagtgcggccaccacgccttcagcgactac

SEQ ID NO: 28658 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28659 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaacgtctggaaccgacaacctcaagcgcgtcccctgcgagacaccgcccttcactgtaactcaagaaagcaatcccaccgcactgtttcaaaccaaccacccctcgctctttctcctacctcatctggcacatcatcatagcctcctgcttctactacgtcgccaccgcttacttccccctcctccctcaccctctctcctacttcgcctggcctctctactgggcctgccagggctgcgtcctaaccggcgtctgggtcatagcccacgagtgcggccaccacgccttcagcgactac

SEQ ID NO: 28660 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgggcctgccagggctgcgtcctaaccggcgtctgggtcatagcccacgagtgcggccaccacgccttcagcgactac

SEQ ID NO: 28661 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 28662 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgccttcagcgactac

SEQ ID NO: 28663 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccactcacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28664 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctaccccatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28665 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28666 - DNA, 439 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgtgccacgctgagagccagcagcaaatgaaaaatctaaagggggtcaagccgtgggcctggcacagcaccggcaagcaggcgctggagaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28667 - DNA, 344 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28668 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28669 - DNA, 349 bp, Artificial
  Mutation in BnaA.FAD2.a introduced by TALE nuclease pair BnFAD2_T03
caggatacatgggtgcaggtggaacaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28670 - DNA, 304 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcaatcccaccgcactgtttcaaacgcttgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28671 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28672 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccgtcagcgactac

SEQ ID NO: 28673 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28674 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttccactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28675 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgattctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28676 - DNA, 350 bp, Artificial
  Mutation in BnaA.FAD2.a introduced by TALE nuclease pair BnFAD2_T03
caggatccatggttgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28677 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28678 - DNA, 319 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28679 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaatgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28680 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28681 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtacggccaccacgccttcagcgactac

SEQ ID NO: 28682 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28683 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaacctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28684 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagtcgtctgaaaccgacaccatcaagcgcgtaccctgcgagacaccacccttcactgaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgggcctgccagggctgcgtcctaaccggcgtctgggtcatagcccacgagtgcggccaccacgccttcagcgactac

SEQ ID NO: 28685 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28686 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28687 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28688 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttggcgatggccaccacctgctggggggtcaagccgtgggcctggcacagcaccagaactcaagaaagcaatcccaccgcactgtttcaaacgctcgatccctcgctctttctcctacctcatctgggacatcatcatagcctcctgcttctactacgtcgccaccacttactgccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28689 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatccgggacatcatcatagcctcctgcttctactacgtcgccaccacttacttccctctcctccctcaccctctctcctacttcgcctggcctctctactgggcctgccagggctgcgtcctaacgggcctctgggtcatcgaccacgaatgcggccaccacgccttcagcgactac

SEQ ID NO: 28690 - DNA, 349 bp, Artificial
  Mutation in BnaA.FAD2.a introduced by TALE nuclease pair BnFAD2_T03
caagatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28691 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccacctcactgcttcaaacgctccatccctcgctctttctcctacctcatctgggacatcatcatagcctcctgcttctactacgtcgccaccactcacttccctctcctccctcaccctctctcctacttcgcctggcctctctactgggcctgccagggctgtgtcctaaccggcgtctgggtcatagcccacgagtgcggccaccacgccttcagcgactac

SEQ ID NO: 28692 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaatggtgcgtcctaaccggcgtctgggtcatagcccacgagtgcggccaccacgccttcagcgactac

SEQ ID NO: 28693 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 28694 - DNA, 392 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtggacaccaaggcctactccggcggctacaacctgcccatcggccaggccgacgaagaactcaagaaagcaatcccaccgcactgtttcaaacgctcgatccctcgctctttctcctacctcctcttcgacatcctcgtctcctcctccctctcccacctccccacagcctactcccctctcccttacctcgcctgacccctctactgggcctgccaaggctgcgtcctaacgggcctctgggtcatagcccacgagtgcggccaccacgccttcagcgactac

SEQ ID NO: 28695 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 28696 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaaccttcggtttgatcttctcctgttgctcggctatgtgccaggccatgctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcgtctgggtcatagcccacgagtgcggccaccacgccttcagcgactac

SEQ ID NO: 28697 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28698 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttggcgatggccaccacctgctggggggtcaagccgtgggcctggcacagcaccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 28699 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgcacgatccctcgctctttctcctacctcatctgggacatcatcatatcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28700 - DNA, 398 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggcgactgccctgctgcgtaacatcgttgctgctccataacatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28701 - DNA, 398 bp, Artificial
  Mutation in BnaA.FAD2.a introduced by TALE nuclease pair BnFAD2_T03
caggatccatgggtgccggtggaagaatgcaagtgtctcctccctccaagaagtctgaaaccgacaccatcaagcgcgtaccctgcgagacaccgcccttcactgtcgggcgactgccctgctgcgtaacatcgttgctgctccataacatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28702 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggctgcggcgagcggagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28703 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28704 - DNA, 371 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcgggtgtgggggttacgtagacctcaagaaagcaatcccacctcaccgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28705 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagctcgtaccctgcgagacaccgcccttcactgtgccaggcccacggcttgaccccggagcaggtggtggccatcgcgtcgattttgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccagggctgcgtcctaaccggcgtctgggtcatagcccacgagtgcggccaccacgccttcagcgactac

SEQ ID NO: 28706 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaagaactcaagaaagcaatcccaccgcactgtttcaaacgcttgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28707 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggagcgtcctaaccggcgtctgggtcatagcccacgagtgcggccaccacgccttcagcgactac

SEQ ID NO: 28708 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacactcaagaaagcaatcccaccgcactgtttcaaacgctcgatccctcgctctttctcctacctcatctgggacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28709 - DNA, 308 bp, Artificial
  Mutation in BnaA.FAD2.a introduced by TALE nuclease pair BnFAD2_T03
caggatccatgggtgcaggttgaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 28710 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28711 - DNA, 348 bp, Artificial
  Mutation in BnaA.FAD2.a introduced by TALE nuclease pair BnFAD2_T03
caggatccatgggtgccaggtggaagaatgcaagtgtctcctccctccaaaaagtctgaaaccgacaacatcaagcgcgtaccctgcgagacaccgcccttcaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28712 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctatgggtcatcgcccacgaatgcggccaccacgccttcagcgactac

SEQ ID NO: 28713 - DNA, 304 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcaatcccaccgcactgtttcaaacgcttgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28714 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtcccctgcgagacaccaccattcacttagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28715 - DNA, 411 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcaggtcttgaccccggagcaggtggtggccatcgccagccacgatggcggcaagcaggcgctggagaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28716 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaaccttcggtttgatcttctcctgttgctcggctatgtgccaggccatgctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 28717 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28718 - DNA, 318 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccggggctgcgtcctacccggcgtctgggtcatagcccacgagtgcggccaccacgccttcaccgactac

SEQ ID NO: 28719 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28720 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28721 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatcgcccacgaatgcggccaccacgccttcagcgactac

SEQ ID NO: 28722 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctcgatccctcgctctttctcctacctcatctgggacatcatcatagcctcctgcttctactacgtcgccaccacttacttccctctcctccctccccctctctcctacttcgcctggcctctctactgggcctgccagggctgcgtcctaaccggcgtctgggtcatagcccacgagtgcggccaccacgccttcagcgactac

SEQ ID NO: 28723 - DNA, 350 bp, Artificial
  Mutation in BnaA.FAD2.a introduced by TALE nuclease pair BnFAD2_T03
caggatcaatgggtgcaggtggaagaatgcaagtgtctcctccctccaaaaagtctgaaaccgacaacatcaagcgcgtaccctgcgagacaccgcccttcactccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggttatcgcccacgaatgcggccaccacgccttcagcgactac

SEQ ID NO: 28724 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccgatctagaactcaagaaagcaatcccaccgcactgtttcaaacgctcgatccctcgctctttctactacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28725 - DNA, 319 bp, Artificial
  Mutation in BnaA.FAD2.a introduced by TALE nuclease pair BnFAD2_T03
caggatccatgggtgcaggtggaagaatgcaagtctctcctccctccagctcccccggaaccaaaaccctcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28726 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28727 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctctctcctacctcttctgggccatcatcttagcctcctccttctactacgtcgccccctcttacttccctctcctccctcaccctctcccctacttcgcctggcccctctactgggcctgccagggctgcgtcctaaccggcgtctgggtcatagcccacgagtgcggccaccacgccttcagcgactac

SEQ ID NO: 28728 - DNA, 382 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgatagttgagtcgatacttcggcgatcaccgctgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28729 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcatcgactac

SEQ ID NO: 28730 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28731 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28732 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 28733 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28734 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28735 - DNA, 410 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgactcaagacgatagttaccggataaggcgcagcggtcgggctgaacggggggtcgaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctagcctctctactgggcctgccagggctgcgtcctaaccggcgtctgggtcatagcccacgagtgcggccaccacgccttcagcgactac

SEQ ID NO: 28736 - DNA, 371 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28737 - DNA, 424 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgtgccacgctgagagccagcagcaaatgaaaaatctaaagggggtcaagccgtgggcctggcacagcaccggcaagcaggcgctggagaagaactcaagaaagcaatcccaccgcactgtttcaaacgctcgatccctcgctctttctcctacctcctcttcgccatcctcgtctcctcctccccctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 28738 - DNA, 337 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28739 - DNA, 349 bp, Artificial
  Mutation in BnaA.FAD2.a introduced by TALE nuclease pair BnFAD2_T03
caggatccatgggtgcaggtggaacaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28740 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28741 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagaactcaagaaagcaatcccaccgcactgtttcaaacgctcgatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28742 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttcgcctggcctctctactgggcctgccagggctgcgtcctaaccggcgtctgggtcatagcccacgagtgcggccaccacgccttcagcgactac

SEQ ID NO: 28743 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccactagtgcggccaccactccttcagcgactac

SEQ ID NO: 28744 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactag

SEQ ID NO: 28745 - DNA, 344 bp, Artificial
  Mutation in BnaA.FAD2.a introduced by TALE nuclease pair BnFAD2_T03
caggatccatgggtgcaggtggaagaatgcaagtgtctcatccctccaaaaagtctgaaaccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 28746 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 28747 - DNA, 409 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgcactgacgggtgccccgctcaacttgaccccccagcaggtggtggccatcgccagcaataatggtggcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcgtctgggtcatagcccacgagtgcggccaccacgccttcagcgactac

SEQ ID NO: 28748 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28749 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacgtacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28750 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 28751 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaggtacctcgcgaatgcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28752 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccgatctagaactcaagaaagcaatcccaccgcactgtttcaaacgctcgatccctcgctctttctcctacctcatctggtacatcatcatagcctcctgcttctactacgtcgccaccacttacttccctctcctccctcaccctctcccttccctcgcctggcccctctacggggcctgccaaggctgcgtcctaacgggcctctgggtcatcgcccacgaatgcggccaccacgccttcagcgactac

SEQ ID NO: 28753 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 28754 - DNA, 349 bp, Artificial
  Mutation in BnaA.FAD2.a introduced by TALE nuclease pair BnFAD2_T03
caggatccatgggtgcaggtggaagaatgcaagtctctcctccctccaactcccccgaaaccaaaaccctcaaacgcgtcccctgcgagacaccacccttcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28755 - DNA, 307 bp, Artificial
  Mutation in BnaA.FAD2.a introduced by TALE nuclease pair BnFAD2_T03
caggatccatgggtgcaggtggaagaatgcaagtgtctccccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28756 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctcttcgacatcatcatctcctcctccctctaccacctctccacagcctacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 28757 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 28758 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctcttcgacatcatcatctcctcctccctctaccacctctccacagcctacttccctctcctcccccaccctctcccttacctcgcctggcctctctactgggcctgccagggctgcgtcctaaccggcgtctgggtcatagaccacgagtgcggccaccacgccttcagcgactac

SEQ ID NO: 28759 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 28760 - DNA, 434 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcccagcaggtggtggccatcgccagcaatggcggtggcaagcaggcgctggagacggtccagcggctgttgccggtgctgtgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgtgtcctaaccggcgtctgggtcatagcccacgagtgcggccaccacgccttcagcgactac

SEQ ID NO: 28761 - DNA, 433 bp, Artificial
  Mutation in BnaA.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctctccagcgcctgcttgccggtgctgtgccaggcccacggcttgaccccccagcaggtggtggccatcgccagcaataatggggagacctcaagaaagcaatcccacctcactgcttcaaacgctcgatccctcgctctttctcctccctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28762 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28763 - DNA, 423 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcgatggccaccacctgctccggggtcaagccgtgggcctggcacagcaccggcaacagccgctggagactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28764 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28765 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgaaacaccgcccttccccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggggcatagcccacgagtgcggccaccacgccttcagcgactac

SEQ ID NO: 28766 - DNA, 333 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgtccacgaatgcggccaccacgccttcagcgactac

SEQ ID NO: 28767 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28768 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccacctcttacttccctctcctccctcaccctctcccctacttcgcctggcctctctactgggcctgccagggctgcgtcctaaccggcgtctgggtcatagcccacgagtgcggccaccacgccttcagcgactac

SEQ ID NO: 28769 - DNA, 372 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctcagcggctgttgccggtgctgtgccaggcccccgctcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28770 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcaagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28771 - DNA, 342 bp, Artificial
  Mutation in BnaA.FAD2.a introduced by TALE nuclease pair BnFAD2_T03
caggatccatggatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 28772 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatcagggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28773 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgggagaactcaagaaagcaatcccaccgcactgtttcaaacgctcgatccctcgctctttctcctacctcatctgggacatcctcatagcctccttcttctactacggcgccaccgcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28774 - DNA, 347 bp, Artificial
  Mutation in BnaA.FAD2.a introduced by TALE nuclease pair BnFAD2_T03
catgatccatgggtgcaggtggaagaatgcaagtgtctcctccctccaagaagtctgaaaccgacaccatcaagcgcgtaccctgcgagacaccgcccttcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgtccacgaatgcggccaccacgccttcagcgactac

SEQ ID NO: 28775 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcctggcctctctactgggcctgccagggctgcgtcctaaccggcgtctgggtcatagcccacgcgtgcggccaccacgccttcagcgactac

SEQ ID NO: 28776 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggcggagaactcaagaaagcaatcccaccgcactgtttcaaacgctccatcacacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28777 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 28778 - DNA, 342 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 28779 - DNA, 443 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggaccgtctccagcgcctgcttgccaccattattgctggcgatggccaccacctgctggggggtcaagccgtgggcctggcacagcaccggcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgacta

SEQ ID NO: 28780 - DNA, 383 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagcaggtggtggccatcgccagccacgatggcggcaagcaggcgctggagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28781 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcgctgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28782 - DNA, 336 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28783 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagtgctgcgtcctaaccggcgtctgggtcatagcccacgagtgcggccaccacgccttcagcgactac

SEQ ID NO: 28784 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccccgcaccttctcctacctcatctgggacatcatcatagcctcctgcttctactacgtcgccaccacttacttccctctcctccctcaccctctctcctactacgcctggcctctctacggggcctgccagggctgcgtcctaaccggcgtctgcgtcatagcccacgagtgcggccaccacgccttcagcgactac

SEQ ID NO: 28785 - DNA, 277 bp, Artificial
  Mutation in BnaA.FAD2.a introduced by TALE nuclease pair BnFAD2_T03
caggatccatgggtgcaggtggaagaatgcaagtgtctcatccctccaaaaagtctgaaaccgacaacatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28786 - DNA, 316 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgagcctgccagggctgcgtcctaaccggcgtctgggtcatagcccacgagtgcggccaccacgccttcagcgactac

SEQ ID NO: 28787 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagccaacgagtgcggccaccacgccttcagcgactac

SEQ ID NO: 28788 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcttctgggtcatagcccacgagtgcggccaccacgccttcagcgactac

SEQ ID NO: 28789 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatatcccacgagtgcggccaccacgccttcagcgactac

SEQ ID NO: 28790 - DNA, 327 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 28791 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgtgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28792 - DNA, 316 bp, Artificial
  Mutation in BnaA.FAD2.a introduced by TALE nuclease pair BnFAD2_T03
caggatccattggtgcaggtggaagaatgcaagtgtctcctccctccaaaaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatagcccacgagtgcggccaccacgccttcagcgactac

SEQ ID NO: 28793 - DNA, 394 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgccggtgctgtgccaggcccacggcttgaccccccagcaggtggtgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 28794 - DNA, 447 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcgcctgcttgccgccatcgtggctggcgatggccaccacctgctccgggtcaagccgtgggcctggcacagcaccggcaacagccgctggacggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28795 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgcctagggtgcgtcctaaccggcgtctgggtcatagcccacgagtgcggccaccacgccttcagcgactac

SEQ ID NO: 28796 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28797 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 28798 - DNA, 317 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatacgcaaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28799 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgaacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28800 - DNA, 345 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28801 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccaacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28802 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 28803 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccatcagcgactac

SEQ ID NO: 28804 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 28805 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggtggccatcgccgtgggcctggcacagcaccggcaacagccgctggaccgtctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28806 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28807 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28808 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 28809 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 28810 - DNA, 380 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtatcgacaaataatgattttattttgactgatagtgacctgttggagaactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28811 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 28812 - DNA, 358 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggccatcgcccacgaatgcggccaccacgccttcagcgactac

SEQ ID NO: 28813 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 28814 - DNA, 349 bp, Artificial
  Mutation in BnaA.FAD2.a introduced by TALE nuclease pair BnFAD2_T03
caggatccatgggtgcaggtgtaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28815 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgtccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28816 - DNA, 397 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagcaggtggtggccatcgccagccacgatggcggcaagcaggcgcaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28817 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28818 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcacgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 28819 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28820 - DNA, 410 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgactcaagacgatagttaccggataaggcgcagcggtcgggctgaacggggggtcgaggagaactcaagaaagcaatcccaccgcactgtttcaaacgctcgatccctcgctctttctcctacctcatctgggacatcatcatagcctcctgcttctactacgtcgccaccccttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28821 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccccgcgagacaccgcccttcactgtagaactcaagaaagcaatcccaccgcactgtttcacacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactcc

SEQ ID NO: 28822 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctcttcctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28823 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 28824 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 28825 - DNA, 417 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccggccacttcaagggcaactacaaggcccagctgaccaggctgaaccacatcaccaactgcggagaactcaagaaagcaatcccaccgcactgtttcaaacgctcgatccctcgctctttctcctacctcatctgggacatcatcatagcctcctgcttctactacgtcgccaccacttacttccctctcccccctcaccctctctcctacttcgcctggcctctctactgggcctgccagggctgcgtcctaacgggcctctgggtcatcgcccacgaatgcggccaccacgccttcagcgactac

SEQ ID NO: 28826 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28827 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactccgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28828 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgccgcgcctggcccctctactgggcctgccaaggctgcgtcctaacgggcctcggggtcatagcccacgagtgcggccaccacgccttcagcgactac

SEQ ID NO: 28829 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaaccggcgtctgggtcatagcccacgagtgcggccaccacgccttcagcgactac

SEQ ID NO: 28830 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgcctccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28831 - DNA, 337 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28832 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgatacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28833 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacttggcctgccagggctgcgtcctaaccggcgtctgggtcatagcccacgagtgcggccaccacgccttcagcgactac

SEQ ID NO: 28834 - DNA, 331 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgggagaactcaagaaagcaatcccaccgcactgtttcaaacgctcgacccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 28835 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 28836 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgagtcatagcccacgagtgcggccaccacgccttcagcgactac

SEQ ID NO: 28837 - DNA, 409 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgcactgacgggtgccccgctcaacttgaccccccagcaggtggtggccatcgccagcaataatggtggcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgccttcagcgactac

SEQ ID NO: 28838 - DNA, 304 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28839 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtcttaaaccgacaacatcaagcgcgtaccctgcgatacaccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28840 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28841 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28842 - DNA, 332 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 28843 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaatatcaagcgcgtaccctgcgagacaccgcccttcataagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28844 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaatatcaagcgcgtaccctgcgagacaccgcccttcataagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaaccggcgtctgggtcatagcccacgagtgcggccaccacgccttcagcgactac

SEQ ID NO: 28845 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcgtagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcatcgactac

SEQ ID NO: 28846 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactttttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28847 - DNA, 341 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28848 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccactagtgcggccaccacgccttcagcgactac

SEQ ID NO: 28849 - DNA, 350 bp, Artificial
  Mutation in BnaA.FAD2.a introduced by TALE nuclease pair BnFAD2_T03
ccaggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacctcgcctggcctctctactgggcctgacagggctgcgtcctaaccggcgtctgggtcatagcccacgagtgcggccaccacgccttcagcgactac

SEQ ID NO: 28850 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagactgaaaccgacaacatcaagcgcgtaccctgcgagacaccgccctttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28851 - DNA, 295 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 28852 - DNA, 351 bp, Artificial
  Mutation in BnaA.FAD2.a introduced by TALE nuclease pair BnFAD2_T03
caggatcaatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28853 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28854 - DNA, 408 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcgtcgttccactgagcgtcagaactccggggtcaagccgtgggcctggcacagcaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28855 - DNA, 348 bp, Artificial
  Mutation in BnaA.FAD2.a introduced by TALE nuclease pair BnFAD2_T03
caggatccatgggtgcaggtggaagaatgcaagtgtctcctccctcccaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggttgcgtcctaaccggcgtctgggtcatagcccacgagtgcggccaccgcgccatcagcgactac

SEQ ID NO: 28856 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctcgatacctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28857 - DNA, 338 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28858 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcgtcctaaccggcgtcggggtcatagcccacgagtgcggccaccacgccttcagcgactac

SEQ ID NO: 28859 - DNA, 308 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28860 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28861 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgacac

SEQ ID NO: 28862 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccagcgtctgggtcatagcccacgagtgcggccaccacgccttcagcgactac

SEQ ID NO: 28863 - DNA, 308 bp, Artificial
  Mutation in BnaA.FAD2.a introduced by TALE nuclease pair BnFAD2_T03
caggatccatgggtgcaggtggaagaatgcaagtctctcctccctccaaatagtccgaaaccgacaacatcaagaaagcaatcccaccgcactgtttcaaacgctcgatccctctctctttctcctacctcatctgggacttcatcatagcctcctgcttctactacgtcgcccccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 28864 - DNA, 414 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgccctaaaaaagcattgctcatcaatttgttgcaacgaacaggtcactatcagtcaaaataaaatcattatttgtgagaactcaagaaagcaatcccaccgcactgtttcaaacgctcgatccctcgctctttctcctacctcatctgggacatcatcatagcctcctgcttctactacgtcgccaccacttacttccctctcctccccccccctctcccttccctcgcctggcccctctactgggcctgccaaggctgcgtcctaacgggcctctgggtcatcgcccacgaatgcggccaccacgccttcagcgactac

SEQ ID NO: 28865 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtcccctgcgagacaccgccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28866 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctcccccaccctcgcccttacctcgcctggcccctctactgggcctgccaaggctgcgtcctaacgggcctctgggtcatagcccacgagtgcggccaccacgccgtcagcgactac

SEQ ID NO: 28867 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 28868 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagtcgtctgaaaccgacaccatcaagcgcgtaccctgcgagacaccgcccttcactgtttcaaacgctcgatccctcgctctttctcctacctcatctgggacatcatcataccctcctgcttctactacgtcgccacctcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28869 - DNA, 373 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacattaaccagctgcattaatgaatcggccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 28870 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccagggctgcgtcctaaccggcgtctgggtcatagcccacgagtgcggccaccacgccttcagcgactac

SEQ ID NO: 28871 - DNA, 353 bp, Artificial
  Mutation in BnaA.FAD2.a introduced by TALE nuclease pair BnFAD2_T03
caggatccagggtgcaggtggaagaatgcaagtgctccctccctccaaaaagcctgaaaccgacaacctcaagcgcgtaccctgcgagacaccgcccttcaccgtcggaagaactcaagaaagcaatcccaccgcactgtttcaaacgctcgatccctcgctctttctcctacctcatctgggacatcatcatagcctcctgcttctaccacgtcgccaccacttacttccctctcctcccgcaccctctctcctacttcgcctggcctctctactgggcctgccaagggtgcgtccgaaccggcgtctgggtcatagcccacgagtgcggccaccacgccttcagcgactac

SEQ ID NO: 28872 - DNA, 343 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccatagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 28873 - DNA, 334 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaactgacaacatcaagcgcgtaccctgcgagacaccgcccttcactgtaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28874 - DNA, 414 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctaaaaaagcattgctcatcaatttgttgcaacgaacaggtcactatcagtcacaataaaatcattatttgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28875 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaacgtctgaaaccgacaacatcaagcgcgtcccctgcgagacaccgcccttcactgtcactgtttcaaacgctcgatccctcgctctttctcctacctcatctgggacatcatcataccctcctgcttctactacgtcgcccccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 28876 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactgtcactgtttcaaacgctcgatccctcgctctttctcctacctcatctggcacatcatcatagcctcctgcttctactacgtcgccaccccttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 28877 - DNA, 346 bp, Artificial
  Mutation in BnaA.FAD2.a introduced by TALE nuclease pair BnFAD2_T03
caggatccatgggtgcaggttgaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctacttcgcctggcctctctactgggcctgccagtgctgcgtcctaaccggcgtctgggtcatagcccacgagtgcggccaccacgccttcagcgactac

SEQ ID NO: 28878 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaaccggcgtctgggtcatagcccacgagtgcggccaccacgccttcagcgactac

SEQ ID NO: 28879 - DNA, 351 bp, Artificial
  Mutation in BnaA.FAD2.a introduced by TALE nuclease pair BnFAD2_T03
caggatccatggggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagccactac

SEQ ID NO: 28880 - DNA, 389 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggtttgtttgccggatcaagagctaccaactctttttccgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28881 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccagggctgcgtcctaacgggcctctgggtcatcgcccacgaatgcggccaccacgccttcagcgactac

SEQ ID NO: 28882 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcttcctaaccggcgtctgggtcatagcgcacgagtgcggccaccacgccttcagcgactac

SEQ ID NO: 28883 - DNA, 338 bp, Artificial
  Mutation in BnaA.FAD2.a introduced by TALE nuclease pair BnFAD2_T03
caggatccatgggagcaggtggaagaatgcaagtgtctcctccctccaaaaagactgaaaccgacaacctcaagcgcgtaccctgcgagacaccgcccttcaagaaagcaatcccaaagcactgtttcaaacgctccatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcgtctgggtcatagcccacgagtgcggccaccacgccttcagcgactac

SEQ ID NO: 28884 - DNA, 336 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 28885 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28886 - DNA, 456 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggctgttgccggtgctgtgccaggcccacggcttgaccccggagcaggtggtggccatcgccagcaatattggtggcaagcaggcgctggagacggtgcaggagaactcgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 28887 - DNA, 342 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagtccacgagtgcggccaccacgccttcagcgactac

SEQ ID NO: 28888 - DNA, 333 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacctcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28889 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccaagggtgcgtcctaaccggcgtctgggtcatagcccacgagtgcggccaccacgccttcagcgactac

SEQ ID NO: 28890 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaagcggcgtctgggtcatagcccacgagtgcggccaccacgccttcagcgactac

SEQ ID NO: 28891 - DNA, 277 bp, Artificial
  Mutation in BnaA.FAD2.a introduced by TALE nuclease pair BnFAD2_T03
caggatcaatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28892 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgcgcctgccagggctgtgtcctaaccggcgtctgggtcattgcccaagagtgcggccaccacgccatcagcgactac

SEQ ID NO: 28893 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctcttctgggcctgccagggctgcgtcctaaccggcgtctgggtcatagcccacgagtgcggccaccacgccttcagcgactac

SEQ ID NO: 28894 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccagcgtctgggtcatagcccacgagtgcggccaccacgccttcagcgactac

SEQ ID NO: 28895 - DNA, 295 bp, Artificial
  Mutation in BnaA.FAD2.a introduced by TALE nuclease pair BnFAD2_T03
caggatccatgggtgcaggtggaagaatgcaagtctctcatccctccaggtagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 28896 - DNA, 307 bp, Artificial
  Mutation in BnaA.FAD2.a introduced by TALE nuclease pair BnFAD2_T03
caggatccatgggtgcaggtggaagaatgcaagtctctcctccctccagctcccccggaaccaagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28897 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatcggggacatcatcatagcctcctgcttctactacgtcgccaccacttacttccctctcctcccccaccctctccctttcctcgcctggcccctctactgggcctgccagggctgcgtcctaaccggcgtctgggtcatatcccacgagtgcggccaccacgccttcagcgactac

SEQ ID NO: 28898 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctaaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28899 - DNA, 287 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28900 - DNA, 333 bp, Artificial
  Mutation in BnaA.FAD2.a introduced by TALE nuclease pair BnFAD2_T03
caggatccatgggtgcaggtggaagaatgtaagtgtctcctccctccaaaaagtctgaaaccgacaacatcaagcgcgtaccctgcgagacaccgcccttcactgaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 28901 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatcgcccacgaatgcggccatcacgccttcagcgactac

SEQ ID NO: 28902 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcacttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcggccaccacgccttcagcgactac

SEQ ID NO: 28903 - DNA, 340 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccaactcaagaaagcaatcccaccgcactgttccaaccgctcgatccctcgctctgtcccctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 28904 - DNA, 331 bp, Artificial
  Mutation in BnaA.FAD2.a introduced by TALE nuclease pair BnFAD2_T03
caggatccatgggtgcaggtggaagaatgcaagtctctcctccaccaacaccctcaaacgcgtcccctgcgagacaccaccattcactcacgggagacctcaagaaagcaatcccacctcactgcttcaaacgctccatcccacgctccttctcctcttcgacatcatcatctcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28905 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgctagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28906 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28907 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 28908 - DNA, 277 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28909 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcgaccaccacgccttcagcgactac

SEQ ID NO: 28910 - DNA, 354 bp, Artificial
  Mutation in BnaA.FAD2.a introduced by TALE nuclease pair BnFAD2_T03
caggatccatgggtgcaggtgcaagaatgcaagtgtctcctccctccaaaaagtctgaaaccgacaacatcaagcgcgtaccctgcgagacaccgcccttcactgtcgggaaaactcaagaaagcaatcccaccgcactgtttcaaacgctcgatccctcgctctttatcctacctcatctggtacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcatcgactac

SEQ ID NO: 28911 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaaccccaccgcactgtttcaaacgctcgatccctcgctctttctcctacctcatctgggacatcatcatagcctcctgcttctactacgtcgccaccacttacttccctctcctccctcaccctctctcctacttcgcctcgcctctctactgggcctgccagggctgcgtcctaaccggcgtctgggtcatagcccacgagtgcggccaccacgccttcagcgactac

SEQ ID NO: 28912 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28913 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgcctcaagaaagcaatcccaccgcactgtttcaaacgctcgatccctcgctctttctcctacctcatctgggacatcatcatagcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28914 - DNA, 376 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgctgcgtaacatcgttgctgctccagagacctcaagaaagcaatcccacctcactgcttcaaacgctccatccctcgctccttctcctacctcctctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28915 - DNA, 319 bp, Artificial
  Mutation in BnaA.FAD2.a introduced by TALE nuclease pair BnFAD2_T03
caggatccatgggtgcaggttgaagaatgcaagtctctcctccctccagctcccccggaaccaacaccctcaaacgcgtcccctgcgagacaccacccttcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgctgccaccacgccttcagcgactac

SEQ ID NO: 28916 - DNA, 350 bp, Artificial
  Mutation in BnaA.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctagacctcaagaaagcaatcccaccgcactgtttcaaacgctcgatccctcgctctttctcctacatcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28917 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggtcatcgcccacgaatgcggccaccacgccctcagcgactac

SEQ ID NO: 28918 - DNA, 346 bp, Artificial
  Mutation in BnaA.FAD2.a introduced by TALE nuclease pair BnFAD2_T03
caggatccatgggtgcaggtgcaagaatgcaagtgtctcctccctccaaaaagtctgaaaccgacaacatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 28919 - DNA, 295 bp, Artificial
  Mutation in BnaA.FAD2.a introduced by TALE nuclease pair BnFAD2_T03
caggatccatgggtgcaggtggaagaatgcaagtctctcctccccccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28920 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtccgaaccggcgtcggggtcatagcccgcgagtgcggtcaccgcgccatcagcgactac

SEQ ID NO: 28921 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctctctactgggcctgccagggctgcgtcctaaccggcgtctggttcatagcccacgagtccggccaccacgccctcagcgactac

SEQ ID NO: 28922 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 28923 - DNA, 342 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtccggccaccacgccatcagcgactac

SEQ ID NO: 28924 - DNA, 349 bp, Artificial
  Mutation in BnaA.FAD2.a introduced by TALE nuclease pair BnFAD2_T03
caggatccatgggtgcaggaggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcataatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28925 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28926 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggagaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28927 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcactctttctcctacctcatctgtgacatcatcatcgcctcctgcttctactacgtcgccaccacttacttccctctcctccctcaccctctctcctacttcgcctggcctctctactgggcctgccagggctgcgtcctaaccggcgtctgggtcattgcccacgattgcggccaccacgccttcagcgactac

SEQ ID NO: 28928 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28929 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtccgaaccggcgtcggggtcatagcccacgagtgcggccaccacgccttcagcgactac

SEQ ID NO: 28930 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28931 - DNA, 349 bp, Artificial
  Mutation in BnaA.FAD2.a introduced by TALE nuclease pair BnFAD2_T03
caggatccatgggtgcaggtggaagaatgcaagtgtctcctccccccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcgtcctaaccggcgtctgggtcatagcccacgagtgcggccaccgcgccttcagcgactac

SEQ ID NO: 28932 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacctcccttcactgtcgagaactcaagaaagcaatcccaccgcactgtttcaaacgctcgatccctcgctctttctcctacctcatctggcacataatcatagcctcctgcttctactacgtcgccaccacttacttccctctcctccctcaccctctctcctactgcgcctggccgctctacggggcctgccagggctgcgtcctaacgggcctctgggtcatagcccacgagtgcggccaccacgccatcagcgactac

SEQ ID NO: 28933 - DNA, 430 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtaccctgcgaaacaccgcccttccatttggtacaccgccctacaccgcccttcacacgcccgccataaactgccaggcatcaaactaagcagaaggccatcctgacggagaactcaagaaagcaatcccaccgcactgtttcaaacgctcgatccctcgctctttctcctacctcatcttggacatcatcatcgcctcctgcttctactacgtcgccaccacttacttccctctcctccctcaccctctctcctccttcgcctggcctctctactgggcctgccagggctgcgtcctaaccggcgtctgggtcatagcccacgagtgcggccaccacgccttcagcgactac

SEQ ID NO: 28934 - DNA, 430 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtaccctgcgaaacaccgcccttccatttggtacaccgccctacaccgcccttcacacgcccgccataaactgccaggcatcaaactaagcagaaggccatcctgacggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28935 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttccccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28936 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccctcagcgactac

SEQ ID NO: 28937 - DNA, 304 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcgagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28938 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccgcgagtgcggccaccacgccttcagcgactac

SEQ ID NO: 28939 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccaacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28940 - DNA, 348 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgagcctgccagggctgcgtcctaaccgacgtcggggtcatagccctcgagtgcggccaccacaccttcatccactac

SEQ ID NO: 28941 - DNA, 342 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagaccccgcccttccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagtccacgagtgcggccaccacgccttcagcgactac

SEQ ID NO: 28942 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgtgtgcggccaccgcgccatcagcgactac

SEQ ID NO: 28943 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 28944 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccgcgccatcagcgactac

SEQ ID NO: 28945 - DNA, 304 bp, Artificial
  Mutation in BnaA.FAD2.a introduced by TALE nuclease pair BnFAD2_T03
caggatccatgggtgcaggtggaagaatgtaagtgtctcctccctccaagaagtctgaaaccgaactcaagaaagcaatcccaccgcactgtttcaaacgctcgatccctcgctctttctcctacctcatctggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28946 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28947 - DNA, 369 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaacgaccttttggaaacttcggcttcccctgaaagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 28948 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccacactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 28949 - DNA, 344 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccccgcgagacaccaccaagagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28950 - DNA, 295 bp, Artificial
  Mutation in BnaA.FAD2.a introduced by TALE nuclease pair BnFAD2_T03
caggatccatgggtgcaggtggaagaatgcaagtgtctcctccccccaagaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggtctctctactgggcctgccagggctgcgtcctaaccggcgtctgggtcatagcccgcgagtgcggccaccacgccttcagcgactac

SEQ ID NO: 28951 - DNA, 336 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggactgcgtcctaaccggcgtctgggtcatagcccacgagtgcggccaccacgccttcagcgactac

SEQ ID NO: 28952 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccccctctcctacttcgcctggcctctctactgggcctgccagggctgcgtcctaaccggcgtctgggtcatagcccacgagtgcggccaccacgccttcagcgactac

SEQ ID NO: 28953 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacctcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgattgcggccaccacgccgtcagcgactac

SEQ ID NO: 28954 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcggacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28955 - DNA, 398 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtacttcaagtgtctcctccctccaaaaagtctgaaaccgacaacatacgcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28956 - DNA, 351 bp, Artificial
  Mutation in BnaA.FAD2.a introduced by TALE nuclease pair BnFAD2_T03
caggatccatgggtgcaggtggaagaatgcaagtgtctcctccctcccaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28957 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28958 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 28959 - DNA, 350 bp, Artificial
  Mutation in BnaA.FAD2.a introduced by TALE nuclease pair BnFAD2_T03
caggatccatgggtgcagggggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatcttggacatcatcatagcctcctgcttctacttcgtcgccaccacttacttccctctcctccctcaccctctctcctacttcgcctggcctctctactgggcctgccaagcgtgcgtcctaaccggcgtctgggtcatagcccacgagtgcggccaccacgccttcagcgactac

SEQ ID NO: 28960 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28961 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggttcgtcctaaccggcgtctgggtcatagcccacgagtgcggccaccacgccttcagcgactac

SEQ ID NO: 28962 - DNA, 347 bp, Artificial
  Mutation in BnaA.FAD2.a introduced by TALE nuclease pair BnFAD2_T03
caggatccatgggtgcagatggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28963 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaaccctgaaaccgacaacatcaagcgcgtaccctgcgagacaccgcccttcgctctttctcctacctcatctgggacatcatcatagcctcctgcttctactacgtcgccaccacttacttccctctcatccctcaccctctctcctacttcgcctggcctctctactgggcctgccagggctgcgtcctaaccggcgtctgggtcatagcccacgagtgcggccaccacgccttcagcgactac

SEQ ID NO: 28964 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcctctctactgggcctgccagggctgcgtccgaaccggcgtcggggtcatagcccacgagtgcggccaccacgccttcagcgactac

SEQ ID NO: 28965 - DNA, 347 bp, Artificial
  Mutation in BnaA.FAD2.a introduced by TALE nuclease pair BnFAD2_T03
caggatccatgggtgcaggtggaagaatgcaagtgtctcctcccaccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggcctctctactgggcctgccagggctgcgtcctaaccggcgtctgggtcatagcccacgattgcggccaccaggccttcatcgactac

SEQ ID NO: 28966 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctagctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28967 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccaccgcactgtttcaaacgctcgatccctcgctctttctcctacctcatctgggatatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28968 - DNA, 351 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatcgcccacgaatgcggccaccacgccttcagcgactac

SEQ ID NO: 28969 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 28970 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28971 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcgtctgggtcatcgcccacgaatgcggccaccacgccttcagcgactac

SEQ ID NO: 28972 - DNA, 394 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtgctgtgccaggcccacggcttgaccccccagcaggtggtgggaactcaagaaagcaatcccaccgcactgtttcaaacgctcgatccctcgctctttctcctacatcatctgggacatcatcatagcctcctgcttctactacgtcgccaccacttacttccctctcctccctcaccctctctcctccttcgcctggcctctctactgggcctgccagggctgcgtcctaaccggcttctgggtcatagcccacgagtgtggccaccgcgccttcagcgactac

SEQ ID NO: 28973 - DNA, 394 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtgctgtgccaggcccacggcttgaccccccagcaggtggtgggaactcaagaaagcaatcccaccgcactgtttcaaacgctcgatccctcgctctttctcctacatcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28974 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccatcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggttcatagcccacgagtgcggccaccacgccttcagcgactac

SEQ ID NO: 28975 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccacccttcataagaactcaagaaagcaatcccaccgcactgtttcaaacgctcgatccctcgctatttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28976 - DNA, 379 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggtcatagcattggatcggatcccgggcccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 28977 - DNA, 308 bp, Artificial
  Mutation in BnaA.FAD2.a introduced by TALE nuclease pair BnFAD2_T03
caggatccatgggtgcaggtggaagaatgcaagtgtatcctccctccaaaaagactgaaaccgaccacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctatctggcctctgggtcatagcccgcgagttcggccaccacgccatcagcaactac

SEQ ID NO: 28978 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 28979 - DNA, 370 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaatggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28980 - DNA, 342 bp, Artificial
  Mutation in BnaA.FAD2.a introduced by TALE nuclease pair BnFAD2_T03
caggatccatgggttcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgattgcggccaccgcgccttcagcgactac

SEQ ID NO: 28981 - DNA, 287 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 28982 - DNA, 319 bp, Artificial
  Mutation in BnaA.FAD2.a introduced by TALE nuclease pair BnFAD2_T03
caggatccatgggcgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28983 - DNA, 428 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagcaggtggtggccatcgccagcaatattggtggcaagcaggcgctggagacggtgcaggtggtggggtcaagccgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28984 - DNA, 349 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28985 - DNA, 335 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 28986 - DNA, 385 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtttgggggatcctatcagccgttcccagctggtgaagtccgagctggaggagaactcaagaaagcaatcccaccgcactgtttcaaacgctcgatccctcgctctttctcctcttcgacatcatcacctcctcctcggctcctccctctaccacctctccacagcctacttccctctcccttacttcgcctggcctctctactgggcctgccagggctgcgtcctaaccggcgtctgggtcatagcccacgagtgcggccaccacgccttcagcgactac

SEQ ID NO: 28987 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatctcccacgaatgcggccaccacgccttcagcgactac

SEQ ID NO: 28988 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatcccacgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 28989 - DNA, 380 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgatggccaccacctcctgaggggtcaagccgaactcaagaaagcaatcccaccgcactgtttcaaacgctcgatccctcgctctttctcctacctcatctgggacatcatcatagcctcctgcttctactacgtcgccaccacttacttccctcccctccctcaccctctctcctacttcgcctggcctctctactgggcctgccagggctgcgtcctaaccggcgtctgggtcatagcccacgagtgcggccaccacgccttcagcgactac

SEQ ID NO: 28990 - DNA, 389 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacagcccttcactgatttcttgtcaaaaatgctccactgacgttccataaattcagaactcaagaaagcaatcccaccgcactgtttcaaacgctcgatccctcgctctttctcctacctcatctgggacatcatcatagcctcctgcttctactacgtcgccacctcttacttccctctccgccctcaccctctctcctacttcgcctggcctctctactgggcctgccaagggtgcgtcctaacgggcctctgggtcatagcccacgagtgcggccaccacgccttcagcgactac

SEQ ID NO: 28991 - DNA, 443 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcatgtcctcatacttaaccgcctctccccgcgcgtcgccattgctggcgatggccaccacctgctggggggtcaagccgtgggcctggcacagagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccagggctgcgtcctaaccggcgtctgggtcatagcccacgagtgcggccaccacgccttcagcgactac

SEQ ID NO: 28992 - DNA, 443 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcatgtcctcatacttaaccgcctctccccgcgcgtcgccattgctggcgatggccaccacctgctggggggtcaagccgtgggcctggcacagagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28993 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaagggtgcgtcctaaccggcgtctgggtcatagcccacgagtgcggccaccacgccttcagcgactac

SEQ ID NO: 28994 - DNA, 378 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggctgttgccggtgctgtgccaggcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28995 - DNA, 455 bp, Artificial
  Mutation in BnaA.FAD2.a introduced by TALE nuclease pair BnFAD2_T03
caggatccattggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaacagccgctggaccgtctccagcgcctgcttgccaccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28996 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 28997 - DNA, 326 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgccattcacaccgcactgtttcaagagctcaatccctcgctattgctcctaccgcatctgggacatcatcatatcctcctgcttctactaagccgcccccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 28998 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 28999 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagctcaagaaagcaatcccaccgcactgtttcaaacgctcgacccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctagcgactac

SEQ ID NO: 29000 - DNA, 317 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccatcagcgactac

SEQ ID NO: 29001 - DNA, 396 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggatggccttctgcttagtttgatgcctggcagtttatggcgggcatactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29002 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 29003 - DNA, 300 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgattgcggccaccacgccttcagcgactac

SEQ ID NO: 29004 - DNA, 348 bp, Artificial
  Mutation in BnaA.FAD2.a introduced by TALE nuclease pair BnFAD2_T03
caggatccatgggtgcaggtggaagaatgcaagtgtctccaccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcctctctactgggcctgccagggctgcgtcctaaccggcgtctgggtcatagcccacgagtgcggccaccacgccttcagcgactac

SEQ ID NO: 29005 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatcgcctggcctctctactgcgcctgccagggctgcgtcctaaccggcgtctgggtcatagcccacgagtgcggccaccacgccatcagcgactac

SEQ ID NO: 29006 - DNA, 467 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgatggccaccacctgctccggggtcaagccgtgggccttgcacagcaccggcaacagccgcttgaccccccagcacctccactgcggtcacgccgccacgttttgcaatcttgagaagttggccacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacttggcctgccagggctgcgtcctaaccggcgtctgggtcatagcccacgagtgcggccacgacgcctttagcgactac

SEQ ID NO: 29007 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctttcagcgactac

SEQ ID NO: 29008 - DNA, 349 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcacttagaactcaagaaagcaatcccaccgcactgtttcaaacgctcggtccctcgctctttctcctacctcatctgggacatcatcatagcctcctgcttctactacgtcgccacctcttacttccctctcctccctcaccctctctcctacttcgcctggcctctctactgggcctgccagggctgcgtgctaaccggcgtctgggtcatagcccacgagtgcttccaccacgccttcagcgactac

SEQ ID NO: 29009 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcacacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29010 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29011 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccgtcgtctgggtcatagcccacgactccggcccccccgccctcagcgactac

SEQ ID NO: 29012 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgccccctgcgagacaccgcccttcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29013 - DNA, 329 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcatccaaccgcactgtttcaaacgctcgatccctcgctctttctcctacctcatctgggacatcatcatagcctcctgcttctactaagtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29014 - DNA, 414 bp, Artificial
  Mutation in BnaA.FAD2.a introduced by TALE nuclease pair BnFAD2_T03
caggatccatgggtgcaggtggaagaatgcaagtgtctcctccctccagaaagtctgaaaccgacaacatcaagcgcgtaccctgcgagacaccgcccttcactgtcggggggcggagcctatggaaaaacgccaggaaccgtaaaatatcaaccatagtacgcgccgctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcttacgtcgcctggcctctctactgggcctgccaagggtgcgtcctaaccggcgtctgggtcatagcccacgagtgcggccaccacgccttcagcgactac

SEQ ID NO: 29015 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 29016 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgtccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29017 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 29018 - DNA, 347 bp, Artificial
  Mutation in BnaA.FAD2.a introduced by TALE nuclease pair BnFAD2_T03
caggatccatgggtgcagggggaagaatgcaagtgtctcctcccttcaaaaagtctgaaaccgacaacatcaagcgcgtaccctgcgagacaccgcccttcaaagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctagcctctctactgggcctgccaagggtgcgtcctaaccgtcgtctgggtcatagcccgcaagtgctgccaccacgccttcagcgactac

SEQ ID NO: 29019 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacctacttccctctcctccccccccctctcccttacctcgcctggcccctctactgggcctgccaaggctgcgtcctaacgggcgtctgggtcatagcccacgagtgcggccaccacgccatcagcgactac

SEQ ID NO: 29020 - DNA, 355 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29021 - DNA, 419 bp, Artificial
  Mutation in BnaA.FAD2.a introduced by TALE nuclease pair BnFAD2_T03
caggatccatgggtgcaggtggaataatgcaagtgtctcctccctccaagaagtccgaaaccgacaccatcaagcgcgtaccctgtgagacaccgcccttcactgtccgactgagcctttcgttttatctgttgtttgtcggtgaacgctctcctgagtaggacaaatccgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29022 - DNA, 325 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29023 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 29024 - DNA, 345 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29025 - DNA, 456 bp, Artificial
  Mutation in BnaA.FAD2.a introduced by TALE nuclease pair BnFAD2_T03
caggatccatgggtgcaggtggaagaatgcaagtgcctcctcactccaagaagtctgaaaccgacaacatcaagcgcgtaccctgcgagacaccgcccttcactgtcggcggctgttgccggtgctgtgccaggcccacggcttgaccccggagcaggtggtggccatcgccagcaatattggtggcaagcaggcgctggagacggtgcaggagaactcaagaaagcaatcccaccgcactgtttcaaacgctcgatccctcgctctttcacctacctcatctgagacatcatcatagcctcctgcttctactacgtcgccaccacttacttccctctcctccctcaccctctctcctgcttcgcctggcctctctactgggcctgccagggctgcgtcctaaccggcgtctgggtcatagcccgcgagtgcggccaccacgccttcagcgactac

SEQ ID NO: 29026 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtgaacgctctcctgagtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 29027 - DNA, 350 bp, Artificial
  Mutation in BnaA.FAD2.a introduced by TALE nuclease pair BnFAD2_T03
caggatccatgggtgcaggtggaagaatgcaagtgtctcctccctcccaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagtgctgcgtcctaacgggcctctggttcatagcccacgagtgcggccaccacgccttcagcgactac

SEQ ID NO: 29028 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcatgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29029 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaccatcaagcgcgtaccctgcgagacaccgccattcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29030 - DNA, 390 bp, Artificial
  Mutation in BnaA.FAD2.a introduced by TALE nuclease pair BnFAD2_T03
caggatccatgggtgcaggtggaagaatgcaagtgtctactcactccagctcccccgaaaccaaaaccctcaaacgcgtcccctgcgagacaccaccattcactctggtggccatcgccagcaatggcggtggcaacagccgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29031 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29032 - DNA, 383 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaacgaccttttggaaacttcggcttcccctgaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 29033 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcctctctactgggcctgccaagggtgcgtcctaaccggcgtctgggtcatagcccacgagtgcggccaccacgccttcagcgactac

SEQ ID NO: 29034 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccaggcctctctactgggcctgccaagggtgcgtcctaaccggcgtctgggtcatagcccacgagtgcggccaccacgccttcagcgactac

SEQ ID NO: 29035 - DNA, 373 bp, Artificial
  Mutation in BnaA.FAD2.a introduced by TALE nuclease pair BnFAD2_T03
caggatccatgggtgcaggtggaagaatgcaagtgtcccctccctccaaaaagtctgaaaccgacaacatcaagcgcgtaccctgcgagacactgccaggcatcaaactaagcagaaggccatccgtcaaacgctcaagaaagcaatcccaccgcactgtttcaaacgctcgatccctcgctctttctcctacctcatctgggacatcatcatagcctcctgcttctactacgtcgccaccacttacttccctctcctccctccccctctctcctacctcgcctggcctctctactgggcctgccaagggtgcgtcctaacgggcctctgggtcatcgcccacgaatgcggccaccacgccttcagcgactac

SEQ ID NO: 29036 - DNA, 345 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccaggcctctctactgggcctgccaagggtgcgtcctaaccggcgtctgggtcatagcccacgagtgcggccaccacgccttcagcgactac

SEQ ID NO: 29037 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacctccctccaagtgtctcctccctcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29038 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgcgacaccgtccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagggcggccaccacgccttcagcgacta

SEQ ID NO: 29039 - DNA, 456 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggctgttgccggtgctgtgccaggcccacggcttgaccccggagcaggtggtggccatcgccagcaatattggtggcaagcaggcgctggagacggtgcaggagaactcgagaaagcaatcccaccgcactgtttcaaacgctcgatccctcgctctttctcctacctcacctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29040 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccacactgtttccaacgctcgatccctcgctctttctcccacctcatctgcgccatcatcatagcctcctgcctctcctacaccgccccctcccacttcactctcctccctctccctctcccctacttcgcctggcctctctactgggcctgccaaggctgcgtcctaaccggcgtctgggtcatagcccacgagtgcggccaccacgccttcagcgactac

SEQ ID NO: 29041 - DNA, 319 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtttcaaacgctcgatccctcgctctttctcctacctcatctgggacatcatcatagcctcctgcttctactacgtcgccacctcttacttccctctcctccctcacccactctcctacttcgcctggcctctctactgggcctgccaggactgcgtcctaaccggcgtctgggtcatagcccacgagtgcggccaccacgccttcagcgactac

SEQ ID NO: 29042 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctgtcctccctcaccctctctcctactcccccggccctctctacggggcctgccagggctgcgtcctacccggcgtcggggtcatagcccacgagtccggccaccacgccttcagcgacaac

SEQ ID NO: 29043 - DNA, 349 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29044 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgcaatgagcgactac

SEQ ID NO: 29045 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 29046 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29047 - DNA, 295 bp, Artificial
  Mutation in BnaA.FAD2.a introduced by TALE nuclease pair BnFAD2_T03
caggatccatgggtgcaggtggcagaatgcaagtgtatactcaccccaaaaagtctgaaaccgacaacataaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgtcaagggtgcgtcctaaccggcgtctggggcatagcccgcgagtgcggcctccacgcctgcagcgactac

SEQ ID NO: 29048 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagtccacgagtgcggccaccacgcctgcagcgactac

SEQ ID NO: 29049 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 29050 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29051 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccagggctgcgtcctaaccggcgtctgggtcatagcccacgagtgcggccaccacgccttcagcgactac

SEQ ID NO: 29052 - DNA, 330 bp, Artificial
  Mutation in BnaA.FAD2.a introduced by TALE nuclease pair BnFAD2_T03
caggatccatgggtgcaggtggaagaattcaagtctctcctccatcccgctcccccgaaaccaaaaccctccaacgcgtcccctgtagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacaagtgcggccaccacgccttcagcgactac

SEQ ID NO: 29053 - DNA, 399 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcaggcccacggcttgaccccggagcaggtggtggccatcgccagcacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 29054 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactataactcaagaaagcaatcccaccgcactgtttcaaaccctcgattcctcgccctttctcctacctcatctcgtacatcatcatatcctcctgtctctactacgtctcctccacttacttccctctcctccctcaccctctctcctacttcgcctcgcctctctactgggcctgccagggctgcgtcctaaccggcgtctgggtcatagcccacgagtgcggccaccacgccttcagcgactac

SEQ ID NO: 29055 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccaagcgtgcgtcctaaccggcgtctgggtcatagcccacgagtgcggccaccacgccttcagcgactac

SEQ ID NO: 29056 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacgtacttccctctcctccctcaccctctctcctacttcgcctcgcctctctactgggcctgccagggctgcgtcctaaccggcgtcggggtcatagcccacgagtgcggccaccacgccctcagcgactac

SEQ ID NO: 29057 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagccaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcgcacgagtgcggccaccacgccttcagcaactac

SEQ ID NO: 29058 - DNA, 408 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcgtcgttccactgagcgtcagaactacggggccaagccgtgggcctggcacagcaccggagaactcaagaaagcaagcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29059 - DNA, 337 bp, Artificial
  Mutation in BnaA.FAD2.a introduced by TALE nuclease pair BnFAD2_T03
caggatccatgggtgcaggtggaagaatgcaagtctatcatacctccagctcccccggaaccaacacactcaaccgcgtcccctgcgagacacctacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgcctggcctctctactgtgccggtcggggctgcgtcctaaccgtcgtcggggtcatagcccacgagtgcggccaccacgccttcagcgactac

SEQ ID NO: 29060 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctccctcatctgggacatcatcatagcctcctgcttctactacgtcgccacctcctacttccctctcctccctcaccctctctcctccttcgcctggcctctctactgggcctgccaagcgtgcgtccttaccggcgtctgggtcatagcccacgagtgcggccaccacgccttcagcgactac

SEQ ID NO: 29061 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctctctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29062 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccagggctgcgtcctaaccggcttcttggtcatagcccacgagtgcggccaccacgccatcagcgactac

SEQ ID NO: 29063 - DNA, 350 bp, Artificial
  Mutation in BnaA.FAD2.a introduced by TALE nuclease pair BnFAD2_T03
caggatccatgggtgcaggtggaagaatgcaagtgtctcctccatccaaaaagcctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccacctcgccttcagcgactac

SEQ ID NO: 29064 - DNA, 350 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29065 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgacccaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29066 - DNA, 455 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaacagccgctggaccgtctccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29067 - DNA, 351 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29068 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29069 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaagcaatcccaccgcactgtttcaaacgctcgatccctcgctctttctcctacctcatcggggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29070 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29071 - DNA, 282 bp, Artificial
  Mutation in BnaA.FAD2.a introduced by TALE nuclease pair BnFAD2_T03
caggatccatgggtgcaggtggaagaatgcaagtctctagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 29072 - DNA, 398 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacctcaagcgcgtaccctgcgagacaccgcccttcactgtcgggcgactgcccagctgcgtaacatcgttgctgctccataacatcggagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29073 - DNA, 448 bp, Artificial
  Mutation in BnaA.FAD2.a introduced by TALE nuclease pair BnFAD2_T03
catgatccatgggtgcaggtggaagaatgcaggtctctcctccctccaaaaagtctgaaaccgacaacatcaagcgcgtaccctgcgagacaccccagcaggtggtgaccatcgccagcaataatggtggcaagccagcggctgttgccggcgctgtgccaggcccacggcttgaccccccagcaggtggtggccatcgccagcaaaactcaataaagcaatcccaccgcgctgtttcaaacgctcgatccctcgctctttctcctaccgcagctgggacatcagcatagccgcctgcttctactacgtcgccaccacttgctgcccgcgcctccctccccctctctcctacgtcgcctggcctctctactgggcctgccaagggtgcgtcctagccggcgtctgggtcatagcccacgagtgcggccaccacgcctgcagcgactac

SEQ ID NO: 29074 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcatcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 29075 - DNA, 428 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttcctttttttctgcgcgtaatctgctgcttgcaaacaaaaaaaccaccgctacccgactgggctggcgatgagcgaaatgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29076 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 29077 - DNA, 349 bp, Artificial
  Mutation in BnaA.FAD2.a introduced by TALE nuclease pair BnFAD2_T03
catgatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactggtcctgccaaggctgcgtcctaacgggcctctgggtcatagcccacgagtgcggccaccacgccttcagcgactac

SEQ ID NO: 29078 - DNA, 372 bp, Artificial
  Mutation in BnaA.FAD2.a introduced by TALE nuclease pair BnFAD2_T03
caggatccatgggtgcaggtggaagaatgcaagtgtatactcactccaaaaagtctgaaaccgacaacatcaagcgcgtaccctgcgagacaccgcccttcactgctcacatgttctttcctgcgttatcccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29079 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatcccacgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29080 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaagggtgcgtcctaaccggcgtctgggtcatagcccacgagggcggccaccacgcctgcatcgactac

SEQ ID NO: 29081 - DNA, 340 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccaactcaagaaagcaatcccaccgcactgtttcaaacgctcgatccatcgctctttctcctacctcttctgggactacatcatagcctcctgcttctactacgtcgcctccacttacttccccctcctccctcaccctctctcctacttcgcctggcctctctactgggcctgccagggctgcgtcctaaccggcctctgggtcatagcccacgagtgcggccaccacgccttcagcgactac

SEQ ID NO: 29082 - DNA, 350 bp, Artificial
  Mutation in BnaA.FAD2.a introduced by TALE nuclease pair BnFAD2_T03
caggatccatgggtgcaggtggaagaatgcaagtgtctcccccctcaaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccagggctgcgtcctaaccggcgtcggggtcatagcccgcgagtgcggccaccacgccttcagcgactac

SEQ ID NO: 29083 - DNA, 349 bp, Artificial
  Mutation in BnaA.FAD2.a introduced by TALE nuclease pair BnFAD2_T03
caggatccatgggtgcaggtggaagaatgcaagtatctactccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacctggcctctctacttggcctgccagggctgcgtcgtaaccggcgtctgggtcatagcccacgagtgctgtcaccgcgccttcaggcgactac

SEQ ID NO: 29084 - DNA, 350 bp, Artificial
  Mutation in BnaA.FAD2.a introduced by TALE nuclease pair BnFAD2_T03
caggatccatgggtgcaggtggcagaatgcaagtgtctactccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29085 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 29086 - DNA, 442 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgtccagcggctgttgccggtgctgtgccaggcccacggcttgaccccggagcaggtggtggccatcgccagccacgatggcggcaagcaggcgccggagagagacctcaagaaagcaatcccaccgcactgtttcaaacgctcgatccctcgctctttctcctccctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccgcgagtgcggccaccacgccttcagcgactac

SEQ ID NO: 29087 - DNA, 306 bp, Artificial
  Mutation in BnaA.FAD2.a introduced by TALE nuclease pair BnFAD2_T03
caggatccatgggtgcaggtggcagaatgcaagtctatactccctccagctcccccgaaaccaaaaccctcaaacgcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaactgcgtctgggtcatcgcccacgaatgcgtcctccacgccttcagcgactac

SEQ ID NO: 29088 - DNA, 350 bp, Artificial
  Mutation in BnaA.FAD2.a introduced by TALE nuclease pair BnFAD2_T03
caggatccatgggtgcaaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29089 - DNA, 394 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgccggtgctgtgccaggcccacggcttgaccccccagcaggtggtgcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29090 - DNA, 350 bp, Artificial
  Mutation in BnaA.FAD2.a introduced by TALE nuclease pair BnFAD2_T03
caggatccatgggtgcaggtggaagaatgcaagtgtatactccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29091 - DNA, 442 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggctgttgccggtgctgtgccaggcccacggcttgaccccggagcaggtggtggccatcgccagccacgatggcggcaacagccgctggacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29092 - DNA, 336 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaaacgcgtcccatgttatcgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29093 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggtggccatcgccgtgggcctggcacagcaccggcaacagccgctggaccgtctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcctggcctctctactggtcctgccaagggtgcgtcctaacgggcctctgggtcatcgcccacgaatgctgccaccacgccttcagcgactac

SEQ ID NO: 29094 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29095 - DNA, 283 bp, Artificial
  Mutation in BnaA.FAD2.a introduced by TALE nuclease pair BnFAD2_T03
caggatccatgggtgcaggtggaagaatgcaagtgtatactccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29096 - DNA, 345 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaccatcaagcgcgtaccctgcgagacaccacccttaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29097 - DNA, 345 bp, Artificial
  Mutation in BnaA.FAD2.a introduced by TALE nuclease pair BnFAD2_T03
caggatccatgggtgcaggtggcagaatgcaagtgtatcctcactccaaaaagtctgaaaccgacaacatcaagcgagtaccctgcgagacaccgcccctcactactcaagaaagcaatcccaccgcactgtttcaaacgctcgatccctcgctctttctcctacctcatctgggacatcatcatagcctcctgcttctactacgtcgccaccacttacttccctctcctcactcaccctctctcctacttcgcctggcctctctactgggcctgccagggctgcttcctaaccggcgtcggggtcatagcccgcgagtgcggcctccacgccttcagcgactac

SEQ ID NO: 29098 - DNA, 325 bp, Artificial
  Mutation in BnaA.FAD2.a introduced by TALE nuclease pair BnFAD2_T03
caggatctgggtgcaggtggcagaatgcaagtgtccactccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaagggtgcgtcctaacgggcctctgggtcatagcccacgagtgcggccaccacgccttcagcgactac

SEQ ID NO: 29099 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 29100 - DNA, 412 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactgggcctttcgttttatctgttgtttgtcggtgaacgctctcctgagtaggacaaatccggagaactcaagaaagcaatcccaccgcactgtttcaaacgctcgattcctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29101 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagccccctagtgcggccaccacgccttccgcgactac

SEQ ID NO: 29102 - DNA, 308 bp, Artificial
  Mutation in BnaA.FAD2.a introduced by TALE nuclease pair BnFAD2_T03
caggatccatgggtgcaggtggcagaatgcaagtctctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggggcatagcccacgagtgcggccaccacgccttcagcgactac

SEQ ID NO: 29103 - DNA, 341 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcacactac

SEQ ID NO: 29104 - DNA, 410 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacaccgcccttcactgtcggttcagcctggtcagctgggccttgtagttgcccttgaagtggccggacacgaacaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29105 - DNA, 380 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcccacggcttgaccccccagcaggtggtggccatcgccagcagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 29106 - DNA, 350 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcacgcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctcggggtcatcgcccacgaatgcggccaccacgccttcagcgactac

SEQ ID NO: 29107 - DNA, 350 bp, Artificial
  Mutation in BnaA.FAD2.a introduced by TALE nuclease pair BnFAD2_T03
caggatccatgggtgcaggtggaagaatgcaagtgtatactccctccaagaagtctgaaaccgacaccatccagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctcggggtcatcgcccacgaaggcgtccagcacgccttcagcgactac

SEQ ID NO: 29108 - DNA, 347 bp, Artificial
  Mutation in BnaA.FAD2.a introduced by TALE nuclease pair BnFAD2_T03
caggatccatgggtgcaggtggcagaatgcaagtgtatactccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29109 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29110 - DNA, 355 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaccatcaagcgcgtaccctgcgagacaccgcccttcactgtcgcggagaactcaagaaaacaatcccaccgcaccgtttcaaacgctcgatccctcgctctttctcctacctcatctgggacatcatcatagcctcctgcttctactacgtcgccaccacttacttccctctcctccctcaccctctcccctacttcgcctggcctctctactgggcctgccagggctgcgtcctaaccggcgtctgggtcatagcccacgagtgcggccaccacgccttcagcgactac

SEQ ID NO: 29111 - DNA, 348 bp, Artificial
  Mutation in BnaA.FAD2.a introduced by TALE nuclease pair BnFAD2_T03
caggatccatgggtgcaggtggcagaatgcaagtgtctcctcccacaaaaaagtctgaaaccgacaacatcaagcgcgtaccctgcgagacaccgcccttcactggaactcaagaaagcaatcccgccgcactgtttcaaacgctcgatccctcgctctttctcctacctcatctgggacatcatcatagcctcctgcttctactacgtcgccaccacttacttccctctcctccctcaccctctctcctacttcgcctcgcctctctactgggcctgccaagggtgcgtcctaaccggcgtctggggcatagcccacgagtgcgtccaccacgccttcagcgactac

SEQ ID NO: 29112 - DNA, 348 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29113 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccaccgcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29114 - DNA, 338 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccatcaagcgcgtaccctgcgagacaccgcccttcactaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29115 - DNA, 349 bp, Artificial
  Mutation in BnaA.FAD2.a introduced by TALE nuclease pair BnFAD2_T03
caggatccatgggtgcaggtggcagaatgcaagtgtatactccctcaaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29116 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccacctcactgcttcaaatgctccatccctcgctccttctcctacctcatctgggacatcatcatagcctcctgcttctactacgtcgccaccacttacttccctctcctccttcaccctctctcctacttcgcctggcctctctactgggcctgccagggctgcgtcctaaccggcgtctgggtcatagcccacgagtgcggccaccacgccttcagcgactac

SEQ ID NO: 29117 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 29118 - DNA, 317 bp, Artificial
  Mutation in BnaA.FAD2.a introduced by TALE nuclease pair BnFAD2_T03
cgggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29119 - DNA, 353 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcacgactac

SEQ ID NO: 29120 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 29121 - DNA, 345 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgtcctctctactgggcctgccagggctgcgtcctaaccggcgtctgggtcatagcccacgagtgcggccaccacgccttcagcgactac

SEQ ID NO: 29122 - DNA, 335 bp, Artificial
  Mutation in BnaA.FAD2.a introduced by TALE nuclease pair BnFAD2_T03
caggatcatgggtgcaggtggaagaatgcaagtgtctcctccctccaaaaagtctgaaaccgacaacatcaagcgcgtaccctgcgagacaccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29123 - DNA, 333 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29124 - DNA, 449 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcttccagggggaaacgcctggtatctttatagtcctgtcgggtttcgccacctctgacttgagcgtcgatttttgtgatgctcgtcaggggggcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29125 - DNA, 413 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgccgctggaccgtctccagcgcctgcttgccaccattattgctggcgatggccactacctgcttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29126 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccaccattctctcggagacctcaagaaagcaatcccaccgcactgtttcaaacgctctatccctcgctctttctcctacctcatctggaacatcatcatagcctcctgcttctactacgtcgccaccacttacttccctctcctccctcaccctctctcctacctcgcctggcctctctactgggcctgccaagggtgcgtcctaacgggcctctgggtcatcgcccacgaatgcggccaccacgccttcagcgactac

SEQ ID NO: 29127 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgtcaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29128 - DNA, 354 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgattgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacagggcctgccagggctgcgtcctaaccggcgtctgggtcatagcccacgagggcggccaccacgcctgcagcgactac

SEQ ID NO: 29129 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttgcctctctactgggcctgccaagggtgcgtcctaaccggcgtctgggtcatagcccacgagtgcggccaccacgccttcagcgactac

SEQ ID NO: 29130 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtctggcctctctactgggcctgccagggctgcgtcctaaccggcgtctgggtcatagcccacgagtgcggccaccacgccttcagcgactac

SEQ ID NO: 29131 - DNA, 350 bp, Artificial
  Mutation in BnaA.FAD2.a introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29132 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggtctgccagggctgcgtcctaaccggcgtctgggtcatagcccacgagtgcggccaccacgccttcagcgactac

SEQ ID NO: 29133 - DNA, 304 bp, Artificial
  Mutation in BnaA.FAD2.a introduced by TALE nuclease pair BnFAD2_T03
caggatccatgggtgcaggtggaagaatgcaagtgtctcctccctcaaaaaagtctgaaaccgacaacatcaagcaatcccaccgcactgtttcaaacgcttgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29134 - DNA, 351 bp, Artificial
  Mutation in BnaA.FAD2.a introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactcggagacctcaagaaagcaatcccacctcactgcttcaaacgctcgatccctagctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29135 - DNA, 396 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggttcctggccttttgctggccttttgctcacatgttctttccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29136 - DNA, 351 bp, Artificial
  Mutation in BnaA.FAD2.a introduced by TALE nuclease pair BnFAD2_T03
caggatccatgggtgcaggtggcagaatgcaagtgactcctccctcaaaaaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggcggcgtccgaacgggcctctgggtcatagcccacgagtgcggcgaccacgccttcagcgactac

SEQ ID NO: 29137 - DNA, 401 bp, Artificial
  Mutation in BnaA.FAD2.a introduced by TALE nuclease pair BnFAD2_T03
caggatccatgggtgcaggtggaagaatgcaagtgtctcctccctccaagaagtccgaaaccgacaccatcaagcgcgtaccctgcgagacaccgcccttcactgtgggccttgtagttgcccttgaagtggccggacacgaacaggaacttgaactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29138 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgagaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29139 - DNA, 349 bp, Artificial
  Mutation in BnaA.FAD2.a introduced by TALE nuclease pair BnFAD2_T03
caggatccatgggtgcaggtggcagaatgcaagtgtctacaccctccaaaaagtctgaaaccgacaacatcaagcgcgtaccctgcgagacaccgcccttcactgtagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgccttcagcgactac

SEQ ID NO: 29140 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaaccggcgtctgggtcatagcccacgagtgcggccaccacgccttaagcgctac

SEQ ID NO: 29141 - DNA, 420 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttgccgatgctgtgccaggcccacggcttgaccccccagcaggtggtggccatcgccagcaatggcggtggagacctcaagaaagcaatcccaccgcactgtttcaaacgctcgatccctcgctctttctcctacctcatctgggacatcatcatagcctcctgcttctactacgtcgccaccacttacttccctctcctccctcaccctcgctcctacttcgcctggcctctctactgggcctgccagggctgcgtcctaaccggcgtctgggtcatagcccacgagtgcggccaccacgccttcagcgactac

SEQ ID NO: 29142 - DNA, 277 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcatggcctctctactgggcctgccagggctgcgtcctaaccggcgtctgggtcatagcccacgagtgcggccaccacgccttcagcgactac

SEQ ID NO: 29143 - DNA, 312 bp, Artificial
  Mutation in BnaA.FAD2.a introduced by TALE nuclease pair BnFAD2_T03
caggatccatgggtgcaggtggcagaatgcaagtgtatactccctccaaaaagtctgaaaccgacaacatcaagcgcgtaccctgcgagacaccgcccttcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 29144 - DNA, 409 bp, Artificial
  Mutation in BnaA.FAD2.a introduced by TALE nuclease pair BnFAD2_T03
caggatccatgggtgcaggtggaagaatgcaagtgtctcctccctcccaaaagtctgaaaccgacaacatcaagcgcgtaccctgcgagacaccgcccttcactgttgcactgacgggtgccccgctcaacttgaccccccagcaggtggtggccatcgccagcaataatggtggcaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccatggctgcgtcctaaccggcgtctgggtcatagcccacgagtgcggccaccacgccttcagcgactac

SEQ ID NO: 29145 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttccccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaaccggcgtctgggtcatagcccacgagtgcggccaccacgccttcagcgactac

SEQ ID NO: 29146 - DNA, 384 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttccccggagcaggtggtggccatcgccagcaatattggtggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagcgcggccaccacgccttcagcgactac

SEQ ID NO: 29147 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29148 - DNA, 414 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggggggcggagcctatggaaaaacgccaggaaccgtaaaatatcaaccatagtacgcgccgctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29149 - DNA, 314 bp, Artificial
  Mutation in BnaA.FAD2.a introduced by TALE nuclease pair BnFAD2_T03
caggatccatgggtgcaggtggaagaatgcaagtatctcctccctccaagaagtctgaaaccgacaccatcaagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29150 - DNA, 377 bp, Artificial
  Mutation in BnaA.FAD2.a introduced by TALE nuclease pair BnFAD2_T03
caggatccatgggtgcaggtcgcagaatgcaagtctctcctccacccagctcccccggacccaacaccatcaaacgcgtcccctgcgagacaccaccattcactctcgcggcgggggtggtgggtacgcgcaaagacctcaagaaagcaaacccaccgcactgtttcaaacgctcgatccctcgctctttctcctacctcatctgggacatcatcatagcctcctgcttctactacgtcgccaccacttgcttccctctcctccctcaccctctctcctacttcgcctggcctctctactgggcctgccagggctgcgtcctaaccggcgtctggggcatagcccacgagtgcggccaccacgccttcagcgactac

SEQ ID NO: 29151 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctccaccctcaccctctctcctacttcgcctggcctctctactgggcctgccaagggtgcgtcctaaccggcgtctgggtcatagcccacgagtgcggccaccacgccttcagcgactac

SEQ ID NO: 29152 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtttgaaaccgacaccatcaagcgcgtaccctgcgagacaccgcccttcagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29153 - DNA, 397 bp, Artificial
  Mutation in BnaA.FAD2.a introduced by TALE nuclease pair BnFAD2_T03
caggatccatgggtgcaggtggaagaatgcaagtgtcttctctctccaaaaagtctgaaactgacaacatcaagcgcgtaccctgcgagacaccgcccttcactgagcaggtggtggccatcgccagccacgatggcggcaagcaggcgctggagaactcaagaaagcaatcccaccgcactgtttcaaacgctcgatccctcgctccttctcctacctcatctgggacatcatcatagcctcctgcttctactacgtcgccaccacgtacttcccccacctccctcaccctctctcctacttcgcctggcctctctactgggcctgccaagggtgcgtcctaaccggcgtctgggtcatagcccacgagtgcggccaccacgccttcagcgactac

SEQ ID NO: 29154 - DNA, 350 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctggcctctctactgggcctgccaagggtgcggccgaaccggcgtctgggtcatagcccacgagtgcggccaccacgccttcagcgactac

SEQ ID NO: 29155 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctcactcctacttcgcctggcctctctactgggcctgccaagggtgcgtcctaaccggcgtctgggtcatagcccacgagtgcggccaccacgccttcagcgactac

SEQ ID NO: 29156 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctaatacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29157 - DNA, 372 bp, Artificial
  Mutation in BnaA.FAD2.a introduced by TALE nuclease pair BnFAD2_T03
caggatccatgggtgcagggggaagaatgcaagtgtctcctcccacaaaaaagtctgaaaccgacaacatcaagcgcgtaccctgcgagacaccgcccttcactgctcacatgttctttcctgcgttatcccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29158 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagcgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29159 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagccctcgagggcggccaccacgccttcatcgactac

SEQ ID NO: 29160 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 29161 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcaccgtttcaaactcaagatctctcgctccctctcctacctcatctgggactccatcatagcctcctgcttctactccgccgccaccacttacttccccctcctccctcaccctctctcctacttcgcctggcctctctactgggcctgccaagggtgcgtcctaacgggcgtctgggtcatagcccacgagtgcggccaccacgccttcagcgactac

SEQ ID NO: 29162 - DNA, 349 bp, Artificial
  Mutation in BnaA.FAD2.a introduced by TALE nuclease pair BnFAD2_T03
caggatccatggtgcaggtggacgaatgcaagtgtctcatccctacaaaaagtctgaaaccgacaacatcaagcacgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 29163 - DNA, 394 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgccggtgctgtgccaggcccacggcttgaccccccagcaggtggtgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 29164 - DNA, 304 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcaatcccaccgcactgtttcaaacgcttgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 29165 - DNA, 350 bp, Artificial
  Mutation in BnaA.FAD2.a introduced by TALE nuclease pair BnFAD2_T03
caggatccatgggtgcaggttgaagaatgcaagtgtctcctcactccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 29166 - DNA, 308 bp, Artificial
  Mutation in BnaA.FAD2.a introduced by TALE nuclease pair BnFAD2_T03
caggatccatgggtgcaggtggaagaatgcaagtgtatactccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29167 - DNA, 350 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 29168 - DNA, 351 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagctactacc

SEQ ID NO: 29169 - DNA, 388 bp, Artificial
  Mutation in BnaA.FAD2.a introduced by TALE nuclease pair BnFAD2_T03
caggatccatgggtgcaggtggcagaatgcaagtgtatactccctccaagaagtctgaaaccgacaccatcaagcgcgtaccctgcgagacaccgcccttcactcacccgtcagtgcattgcgccatgcatgcactgcctccagagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29170 - DNA, 350 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29171 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggtcatagcccacgagggcggccaccacgccttcagcgactac

SEQ ID NO: 29172 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttacctctcctccctcaccctctctcctacttcgcctggcctctctactgggcctgccagggctgcgtcctaaccggcgtctgggtcatagcccacgagtgcggccaccacgccttcagcgactac

SEQ ID NO: 29173 - DNA, 280 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29174 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29175 - DNA, 402 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtccccttcgagacaccacccttcactctcggctgttgccggtgctgtgccaggcccacggcttgaccccccagcaggtggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatggctgcgtcctaaccggcgtctgggtcatagcccacgagtgcggccaccacgccttcagcgactac

SEQ ID NO: 29176 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgcaaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29177 - DNA, 413 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggccatcgccagcaatggcggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29178 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacttcttccaccgtactcaagaaagcaatcccaccgcactgtttcaaacgctcgatccctcgctctttctcctacctcatctgggacatcatcatagcctcctgcttctactacgtcgccaccacttacttccctctccttcctcaccctctctcctacttcgcctggcctctctactgggcctgccagggctgcgtcctaaccggcgtctgggtcatagcccacgagtgcggccaccacgccttcagcgactac

SEQ ID NO: 29179 - DNA, 348 bp, Artificial
  Mutation in BnaA.FAD2.a introduced by TALE nuclease pair BnFAD2_T03
caggatccatgggtgcaggtggaagaatgcaagtgtctcctccttccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29180 - DNA, 391 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccattcactgtacggtccagcggctgttgccggtgctgtgccaggcccacggagaactcaagaaagcaatcccaccgcactgtttcaaacgttcgatccctcgctctttctcctacatcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29181 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29182 - DNA, 340 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctacggggcctgccaaggctgcgtcctaacgggcctctgggtcatagcccacgagtgcggccaccacgcctgcagcgactac

SEQ ID NO: 29183 - DNA, 334 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 29184 - DNA, 323 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtaccctgcgagacaccacccttacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29185 - DNA, 360 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29186 - DNA, 349 bp, Artificial
  Mutation in BnaA.FAD2.a introduced by TALE nuclease pair BnFAD2_T03
caggatccatgggtgcaggtggaagaatgcaagtctatcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29187 - DNA, 325 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29188 - DNA, 341 bp, Artificial
  Mutation in BnaA.FAD2.a introduced by TALE nuclease pair BnFAD2_T03
caggatccatgggtgcaggtggaagaatgcaagtgtctcctccctccaagaagcctgaaaccgacaacatcaagcgcgtaccctgcgagacacccccagaactcaagaaagcaatcccaccacactgcttcaaacgctcgatcacacgctctttctcctacctcatctggcacctcatcatagcctcctgcttctactacgtcgccaccccttacttccccatcctccctcaccctctctcctacttcgcctggcctctctactgggcctgccagggctgcgtcctaaccggcgtctgggtcatagcccacgagtgcggccaccacgccttcagcgactac

SEQ ID NO: 29189 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29190 - DNA, 347 bp, Artificial
  Mutation in BnaA.FAD2.a introduced by TALE nuclease pair BnFAD2_T03
caggatccatgggtgcaggtggcagaatgcaagtgtatcctccctccaaaaagtctgaaaccgacaacatcaagcgcgtaccctgcgagacaccacccttcactgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccagcacgccttcagcgactac

SEQ ID NO: 29191 - DNA, 336 bp, Artificial
  Mutation in BnaA.FAD2.a introduced by TALE nuclease pair BnFAD2_T03
caggatccatgggtgcaggcggaagaatgcaagtgtctactcactccaaaaagtctgaaaccgacaacatcaagcgcgtaccctgcgagacaccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatggctgcgtcctaaccggcgtctgggtcatagcccacgagtgcgtccaccacgcctgcagcgactac

SEQ ID NO: 29192 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctctctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29193 - DNA, 352 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29194 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagtccacgagtgcggccaccacgccttcagcgactac

SEQ ID NO: 29195 - DNA, 349 bp, Artificial
  Mutation in BnaA.FAD2.a introduced by TALE nuclease pair BnFAD2_T03
caggatccatgggtgcaggtggaagaatgcaagtgtctaccccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggtctctctactgggcctgccaagggtgcgtcctaaccggcgtctgggtcatagcccgcgagtgcggccaccacgccttcagcgactac

SEQ ID NO: 29196 - DNA, 345 bp, Artificial
  Mutation in BnaA.FAD2.a introduced by TALE nuclease pair BnFAD2_T03
caggatccatgggtgcaggtggcagaatgcaagtctctcctccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29197 - DNA, 411 bp, Artificial
  Mutation in BnaA.FAD2.a introduced by TALE nuclease pair BnFAD2_T03
caggatccatgggtgcaggtggtagaatgcaagtgtctcctccctccaaaaagtctgaaaccgacaacatcaagcgcgtaccctgcgagacaccgcccttcactgtcggcctggcacagcaccggcaacagccgctggaccgtctccagcgcctgcttgccaccattagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29198 - DNA, 350 bp, Artificial
  Mutation in BnaA.FAD2.a introduced by TALE nuclease pair BnFAD2_T03
caggatccatgggtgcaggtggaagaatgcaagtgcctactccctccaaaaagtctgaaaccgacaacatcaagcgcgtaccctgcgagacgccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29199 - DNA, 312 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 29200 - DNA, 348 bp, Artificial
  Mutation in BnaA.FAD2.a introduced by TALE nuclease pair BnFAD2_T03
caggatccatgggtgcagctcgcagaatgcaagtgtctcctccatccaaaaagtctgaacccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggtctctctactgggcctgccagggctgcgtcctaaccggcgtctggggcatagcccacgagtgcgaccagcacgccttctgcgactac

SEQ ID NO: 29201 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 29202 - DNA, 350 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtagaactcaaggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29203 - DNA, 389 bp, Artificial
  Mutation in BnaA.FAD2.a introduced by TALE nuclease pair BnFAD2_T03
caggatccatgggtgcaggtggaagaatgcaagtgtctcctccctccaaaaagtccgaaaccgacaacatcaagcgcgtaccctgcgagacaccgcccttcactgtcttcaagtatgacgggctgatactgggccggcaggcgctccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29204 - DNA, 415 bp, Artificial
  Mutation in BnaA.FAD2.a introduced by TALE nuclease pair BnFAD2_T03
caggatccatgggtgcaggtggaagaatgcaagtgtctcctccccccaaaaagtctgaaaccgacaccatcaagcgcgtaccctgcgagacaccgcccttcactgcccaccgcttgacccctgagcaggtggtggccatcgccagccacgatggcggcaacagccgctggaagaactcaagaaagcaatcccaccgcactgtttcacacgctcgagccctcgctctttctcctacctcatctgggacatcatcatagcctcctgctgctactacgtcgccaccacgtacttcccgctcctccctcaccctcgctcctacttcgcctggcctctctactgggcctgccagggctgcgtcctaaccggcgtctgggtcatagcccacgagtgcggccaccacgccttcagcgactac

SEQ ID NO: 29205 - DNA, 351 bp, Artificial
  Mutation in BnaA.FAD2.a introduced by TALE nuclease pair BnFAD2_T03
caggatccatgggtacaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29206 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 29207 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccaacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29208 - DNA, 349 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgccaacgaatgcggccaccacgccttcagcgactac

SEQ ID NO: 29209 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29210 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 29211 - DNA, 347 bp, Artificial
  Mutation in BnaA.FAD2.a introduced by TALE nuclease pair BnFAD2_T03
caggatccatgggtgcaggtggcagaatgtaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgcctgcagcgactac

SEQ ID NO: 29212 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcatccctcaccctctctcctacttcgcctggcctctctactgggcctgccaagggtgcgtcctaaccggcgtctgggtcatagcccacgagtgcggccaccacgccttcagcgactac

SEQ ID NO: 29213 - DNA, 352 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29214 - DNA, 398 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtcgggcgactgccctgctgcgtaacatcgttgctgctccataacatcggagaactcaagaaagcaatcccaccgcactgtttcaaacgctcgatccctcgctctttctcctacctcatctgggacatcatcatagcctcctgcttctactacgtcgccaccacttacttcccgctcctccctcaccctctctcctacttcgcctggcctctctactgggcctgccaagggtgcgtcctaaccggcttctgggtcatagcccacgagtgcggccaccacgccttcagcgactac

SEQ ID NO: 29215 - DNA, 407 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtcgtggacaccaaggcctactccggcggctacaacctgcccatcggccaggccgacgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29216 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaacgtctggaaccgacaccatcaagcgcgtcccctgcgagacaccacccttcactgtaagaaagcaatcccaccgcactgtttcaaacgctcgatccctcgctctttctcctacctcatctgagacatcatcataccctcctgcctctactacgtcgccaccacttacttccctctcctccctcaccctctcccttacttcgcctggcctctctactgggcctgccagggctgcgtcctaacgggcctctgggtcatagcccacgagtgcggccaccacgccttcagcgactac

SEQ ID NO: 29217 - DNA, 346 bp, Artificial
  Mutation in BnaA.FAD2.a introduced by TALE nuclease pair BnFAD2_T03
caggatccatgggtgcaggtggaagaatgcaagtgcctcctccctccaagaagtctgaaatcgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgagtctgccagggcggcgtccgaaccggcgtctgggtcagagcccacgatttcggccgcccacgcctgcagcgactac

SEQ ID NO: 29218 - DNA, 350 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29219 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccacgggtgcgtcctaaccggcgtctgggtcatagcccacgagtgcggccaccacgccttcagcgactac

SEQ ID NO: 29220 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29221 - DNA, 295 bp, Artificial
  Mutation in BnaA.FAD2.a introduced by TALE nuclease pair BnFAD2_T03
catgatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29222 - DNA, 444 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggaccgtctccagcgcctgcttgccaccattattgctggcgatggccaccacctgctggggggtcaagccgtgggcctggcacagcaccggcaagaactcaagaaagcaatcccaccgcactgtttcaaacgctcgatccctcgctctttcttctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29223 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcgccctctctcctacttcgcctggcctctctactgggcctgccagggctgcgtcctaaccggcgtctgggtcatagcccacgagtgcggccaccacgccttcagcgactac

SEQ ID NO: 29224 - DNA, 344 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacctcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29225 - DNA, 348 bp, Artificial
  Mutation in BnaA.FAD2.a introduced by TALE nuclease pair BnFAD2_T03
caggatccatgggtgcaggtggaagaatgccagtctatcctccctcccgctcccccgaaaccaaaaccctcaaacgcgtcccctgcgagacaccacccttcactctacctcaagaaagcaatcccaccgcactgtttcaaacgctcgatccctcgctctttctcctacctcatctggcacatcatcatagcctcctgcttctactacgtcgccaccacttacttccctctcctccctcaccctctctcctgcttcgcctggcctctctactgggcctgccagggctgcgtcctaacctgcggctgggtcatcgcccacgaatgcggccaccacgccttcagcgactac

SEQ ID NO: 29226 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29227 - DNA, 356 bp, Artificial
  Mutation in BnaA.FAD2.a introduced by TALE nuclease pair BnFAD2_T03
caggatccatgggtgcaggtggaagaatgcaagtgcctcctccctccaaaaagtctgaaaccgacaacatcaagcgcgtaccctgcgagacaccgcccttcacttcttccaccgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29228 - DNA, 378 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggctgttgcctgtgctgtgccaggcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 29229 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctggcctctctactgggcctgccagggctgcgtcctaaccggcgtctgggtcatagcccacgagtgcggccaccacgccttcagcgactac

SEQ ID NO: 29230 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29231 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29232 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 29233 - DNA, 277 bp, Artificial
  Mutation in BnaA.FAD2.a introduced by TALE nuclease pair BnFAD2_T03
caggatccatgggtgcaggtagaagaatgcaagtctctcctccctccagctcccccggaaccaacaccctcaaacgcgtaccctgcgagacaccgcccttcactgggacatcatcatagcctcctgcttctactacgtcgccaccacttacttccctctcctccctcaccctctctcctacttcgcccggcctctctactgggcctgccagggctgcgtcctaaccggcgtctgggtcatagcccacgagtgcggccaccacgccttcagcgactac

SEQ ID NO: 29234 - DNA, 348 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29235 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 29236 - DNA, 287 bp, Artificial
  Mutation in BnaA.FAD2.a introduced by TALE nuclease pair BnFAD2_T03
caggatccatgggtgcaggtggaagaatgcaagtctctcctccctccaagtagcctgcaaccgacaccctcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29237 - DNA, 401 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttgaccccggagcaggtggtggccatcgccagccacgatggcggcaagcaggcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 29238 - DNA, 348 bp, Artificial
  Mutation in BnaA.FAD2.a introduced by TALE nuclease pair BnFAD2_T03
caggatccatgggtgcaggtggaagaatgcaagtttttactccctccagctcccccgaaaccaaaaccctcaaacgcgtcccctgcgagacaccacccttcactcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcttccgaaccggcgtcgggggcatagcccacgagtgcggccaccacgcctgcagcgactac

SEQ ID NO: 29239 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 29240 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaacgggcctctgggtcatagcccacgagtgcggccaccacgccttcagcgactac

SEQ ID NO: 29241 - DNA, 308 bp, Artificial
  Mutation in BnaA.FAD2.a introduced by TALE nuclease pair BnFAD2_T03
caggatccatgggtgcaggtggcagaatgcaagtgtatactccctccaagaagtctgaaaccgacaccatcaagaaagcaatcccaccgcactgtttcaaacgctcgatccctcgctctttctcctacctcacctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29242 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctgaccggcgtctgggtcatagcccacgagtgctgccaccacgccttcagcgactac

SEQ ID NO: 29243 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggagaactcaagaaagcaatcccaccgcactgtttcaaacgctcaatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29244 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29245 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggttcatagcgcgcaagtgcggccaccacgccatcagcgactac

SEQ ID NO: 29246 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 29247 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 29248 - DNA, 350 bp, Artificial
  Mutation in BnaA.FAD2.a introduced by TALE nuclease pair BnFAD2_T03
caggatccatgggtgcaggtggaagaatgcaagtgtcccctccctccaaaaagtctgaaaccgacaacatcaagcgcgtaccctgcgagacaccgcccttcactccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29249 - DNA, 386 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgccagccacgatggcggcaacagccgctggaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29250 - DNA, 351 bp, Artificial
  Mutation in BnaA.FAD2.a introduced by TALE nuclease pair BnFAD2_T03
caggatccatgggtgcaggtggaagaatgcaagtctctcctccctccaaaacgtctgaaaccgacaacatcaagcgcgtcccctgcgagacaccgcccttcactgtgagaactcaagaaagcaatcccaccgcactgtttcaaacgctccatccctcgctctttctcctacctcatctctgacatcatcatagcctcctccctctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 29251 - DNA, 342 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccagggctgcgtcctaaccggcgtctgggtcatagcccacgagtgcggccaccacgccttcagcgactac

SEQ ID NO: 29252 - DNA, 344 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29253 - DNA, 350 bp, Artificial
  Mutation in BnaA.FAD2.a introduced by TALE nuclease pair BnFAD2_T03
caggatccattggtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttctacttcgcctggcctctctactgggcctgccaagggtgcgtcctaaccggcgtctgggtcatagcccacgagtgcggccaccacgccttcagcgactac

SEQ ID NO: 29254 - DNA, 343 bp, Artificial
  Mutation in BnaA.FAD2.a introduced by TALE nuclease pair BnFAD2_T03
caggatccatgggtgcaggtggaagaatgcaagtctctcctccctcaagctcccccggaaccaacaccctcaaacgcgtcccctgcgagacaccaccattcactctcggaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29255 - DNA, 350 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 29256 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccacaacgccttcagcgactac

SEQ ID NO: 29257 - DNA, 349 bp, Artificial
  Mutation in BnaA.FAD2.a introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29258 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacctcaagcgcgtaccctgcgagacaccgcccttcactgtcgggagacctcagaaaagcaatcccaccgcactgtttcaaacgctcgatccctcgctctttctcctacctaatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29259 - DNA, 448 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcgcctgcttgccgccatcgtggctggcgatggccaccacctgctccggggtcaagccgtgggcctggcacagcaccggcaaccgccgctggacggagacctcaagaaagcaatcccaccgcactgtttcaaacgctcgctcccgcgctctttctcctacctcatctgggacatcagcatagcctcctgcttctactacgtcgccaccgcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29260 - DNA, 363 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggtgaacgctctcctgagtagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 29261 - DNA, 342 bp, Artificial
  Mutation in BnaA.FAD2.a introduced by TALE nuclease pair BnFAD2_T03
caggatccatgggtgcaggtggcagaatgcaagtgtatactccctcccaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29262 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29263 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgtgcctgccaaggctgcgtcctaacgggcctctgggtcatcgcccacgaatgcggccaccacgccttcagcgactac

SEQ ID NO: 29264 - DNA, 349 bp, Artificial
  Mutation in BnaA.FAD2.a introduced by TALE nuclease pair BnFAD2_T03
caggatccatgggtgcaggtggaagaatgcaagtgtctactcactcaaaaaagtctgaaaccgacaacataaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgtcttcgcctggcctctctactgggcctgccatgggtgcgtcctaaccggcgtctgggtcatagcccacgagtgcttccaccacgcctgcagcgactac

SEQ ID NO: 29265 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 29266 - DNA, 401 bp, Artificial
  Mutation in BnaA.FAD2.a introduced by TALE nuclease pair BnFAD2_T03
caggatccatgggtgcaggtggcagaatgcaagtgtctcccccctccaaaaagtctgaaaccgacaacatcaagcgcgtaccctgcgagacaccgcccttcactgtagaaagctggtttgcatgcaggcctctgcagtcgacgggcccgggatccgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29267 - DNA, 351 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29268 - DNA, 350 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaactcaagaaagcaatccccccgcactgtttcaaacgctcgatccctcgctctttctcctacctcatctgagacatcatcatagcctcctgcttctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 29269 - DNA, 350 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29270 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctatcctcccccaccctctcccttacctcgcctggcccctctactgggcctgccaaggctgcgtcctaacgggcctctgggtcatcgcccacgaatgcggccaccacgccttcagcgactac

SEQ ID NO: 29271 - DNA, 401 bp, Artificial
  Mutation in BnaA.FAD2.a introduced by TALE nuclease pair BnFAD2_T03
caggatccatgggtgcaggtggaagaatgcaagtgaataaaccctcaaaaaagtctgaaaacgacaacataaagcgcgtaccctgcgagacaccgcccttcactgtagaaagctggtttgcatgcaggcctctgcagtcgacgggccagggatccgaagaactcaagaaagcaatcccaccgcactgtttcaaacgctcgatccctcgctctttctcctacctcatctgggacatcatcatagcctcctgcttctactacgtcgccaccacttacttccctctccgccctcaccctctctcctacttcgcctggcctctctactgggcctgccaagggtgcgtcctaaccggcgtctgggtcatagcccacgagtgctgcctccacgccttcagcgactac

SEQ ID NO: 29272 - DNA, 344 bp, Artificial
  Mutation in BnaA.FAD2.a introduced by TALE nuclease pair BnFAD2_T03
caggatccatgggtgcaggtggaagaatgcaagtgtctactcactccaaaaagtctgaaaccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 29273 - DNA, 347 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 29274 - DNA, 351 bp, Artificial
  Mutation in BnaA.FAD2.a introduced by TALE nuclease pair BnFAD2_T03
caggatccatgggtgcaggtggaagaatgcaagtgtctcccccctccaaaaagtctgaaaccgacaacatcaagcgcgtaccctgcaagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcggcctaaccggcgtctgggtcatagcccacgagtgcggccaccacgcctgcatcgactac

SEQ ID NO: 29275 - DNA, 309 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaaaccgacaacacccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 29276 - DNA, 389 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcttcaagtatgacgggctgatactgggccggcaggcgctccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgcctgcagcgactac

SEQ ID NO: 29277 - DNA, 344 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 29278 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaaccggcgtctgggtcatagcccacgagtgcggccaccacgccttcagcgactac

SEQ ID NO: 29279 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 29280 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaaccggcgtctgggtcatagcccacgagtgcggccaccacgccatcagcgactac

SEQ ID NO: 29281 - DNA, 349 bp, Artificial
  Mutation in BnaA.FAD2.a introduced by TALE nuclease pair BnFAD2_T03
caggatccatgggtgcaggcggaagaatgcaagtgtctcctcactccaaaaagtctgaaaccgacaacatcaagcgcgtaccctgcgagacaccgcccttcacttagaactcaagaaagcaatcccaccgccctgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacaagtgcggccaccacgccttcagcgactac

SEQ ID NO: 29282 - DNA, 430 bp, Artificial
  Mutation in BnaA.FAD2.a introduced by TALE nuclease pair BnFAD2_T03
caggatccatgggtgcaggtggcagaatgcaagtgtctcctccatccaaaaagtctgaaaccgacaccatcaaacgcgtaccctgcgaaacaccgcccttccatttggtacaccgccctacaccgcccttcacacgcccgccataaactgccaggcatcaaactaagcagaaggccatcctgacggagaactcaagaaagcaatcccaccgcactgtttcaaacgctcgatccctcgctctttctcctacctcatctgggacatcatcatagcctcctgcttctactacgtcgccaccacgtgcttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29283 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29284 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29285 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaacgcaatcccaccgcactgttacaaactctcgatccctctctctttctcctacctcatcttcgccatcatcatagcctcctgcttctactacgacgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29286 - DNA, 437 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtctccagcgcctgcttgccaccattattgctggcgatggccaccacctgctggggggtcaagttgagcggggcacccgtcagtgcatgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29287 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 29288 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtgccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccacaacgccttcagcgactac

SEQ ID NO: 29289 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29290 - DNA, 349 bp, Artificial
  Mutation in BnaA.FAD2.a introduced by TALE nuclease pair BnFAD2_T03
caggatccatgggtgcaggtggaagaatgcaagtctcacatccctccagctcccccggaaccaacaccctcaaacgcgtcccctgcgagacaccaccattcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29291 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactgaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29292 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 29293 - DNA, 343 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccatcggagacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29294 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 29295 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcaccgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29296 - DNA, 304 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcaatcccaccgcactgtttcaaacgcttgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgattgcggccaccacgccttcagcgactac

SEQ ID NO: 29297 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccttgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29298 - DNA, 383 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaagcgcggcgggtgtggtgggtacgcgcataagtgaagggcggtgtaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29299 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactaaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29300 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctccttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29301 - DNA, 396 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggttcctggccttttgctggccttttgctcacatgttctttccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29302 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 29303 - DNA, 351 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29304 - DNA, 349 bp, Artificial
  Mutation in BnaA.FAD2.a introduced by TALE nuclease pair BnFAD2_T03
caggatccatgggtgcaggtggaagaatgcaagtgcctcctccctccaagaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcgtctgggtcatagcccacgagtgcggccaccacgccttcagcgactac

SEQ ID NO: 29305 - DNA, 340 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 29306 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 29307 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgcctgcagcgactac

SEQ ID NO: 29308 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctcctgggcctgcccggcctgcgtcctaaccggcgtctgggtcatagcccaccagtgcggctaccacgccttcagcgactac

SEQ ID NO: 29309 - DNA, 355 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 29310 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29311 - DNA, 349 bp, Artificial
  Mutation in BnaA.FAD2.a introduced by TALE nuclease pair BnFAD2_T03
caggatccatgggtgcaggaggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29312 - DNA, 334 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaactcaagaaagcaatcccaccgcactgtttcaaacgctccatcccacgctccttctcctcttcgacatcatcatctcctcctcggctcctccctctaccacctctccacagcctacttccctctctcctacttcgcctggcctctctactgggcctgccaagggtgcgtcctaaccggcgtctgggtcatagcccacgagtgcggccaccacgccttcagcgactac

SEQ ID NO: 29313 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctcccccccctcaccctctctccctcttcgcctggcctctctactgggcctgccaagggtgcgtcctaaccggcgtctgggtcatagcccacgagtgcggccaccacgccttcagcgactac

SEQ ID NO: 29314 - DNA, 309 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaaccgacaacacccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccgcgagtgcggccaccacgccatcagcgactac

SEQ ID NO: 29315 - DNA, 349 bp, Artificial
  Mutation in BnaA.FAD2.a introduced by TALE nuclease pair BnFAD2_T03
caggatccatggttgcaggtggaagaatgcaagtgtctacttcctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccagggctgcgtcctaaccggcgtctggttcagatcgcacgagtgcggccaccgcgccatcaacgactac

SEQ ID NO: 29316 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctgacccctctactgggcctgccaaggctgcgtcctaacgggcctctgggtcatagcccacgagtgcggccaccacgccttcagcgactac

SEQ ID NO: 29317 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29318 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29319 - DNA, 358 bp, Artificial
  Mutation in BnaA.FAD2.a introduced by TALE nuclease pair BnFAD2_T03
caggatccatgggtgcaggtggaagaatgcaagtctctcctccctcccaaaagtctgaaaccgacaacatcaagcgcgtaccctgcgagacaccgcccttcactgtcggggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29320 - DNA, 452 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaacagccgctggaccgtctccagcgcctgcttgccaccgccattgctggcgatggccaccacctgctggggggtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 29321 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 29322 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcacactctctcctacttcgcctggcctctctactgggcctgccagggctgcgtcctaaccggcgtctgggtcatagcccacgagtgcggccaccacgccttcagcgactac

SEQ ID NO: 29323 - DNA, 413 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgccgctggaccgtctccagcgcctgcttgccaccattattgctggcgatggccactacctgcttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29324 - DNA, 306 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactcaagaaagcaatcccacctcactgcttcaaacgctccatccctcgctccttctcctacctcctcttcgacatcctcgtctcctcctccctctaccacctctcctacttcgcctggcctctctactgggcctgccagggctgcgtcctaaccggcgtctgggtcatagcccacgagtgcggccaccacgccgtcagcgactac

SEQ ID NO: 29325 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29326 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 29327 - DNA, 331 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcagaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 29328 - DNA, 350 bp, Artificial
  Mutation in BnaA.FAD2.a introduced by TALE nuclease pair BnFAD2_T03
caggatccatgggtgcaggtggaagaatgcaagtgtctcctccctccagctcccccggaaccaacaccctcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 29329 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccacgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29330 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcatcctaaccggcgtctgggtcatagcccacgagtgcggccaccacgccttcagcgactac

SEQ ID NO: 29331 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtcttaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaaggcggccaccacgccttcagcgactac

SEQ ID NO: 29332 - DNA, 349 bp, Artificial
  Mutation in BnaA.FAD2.a introduced by TALE nuclease pair BnFAD2_T03
caggatctatgggtgcaggtggaagaatgcaagtgtcccctccttaccaaaagtctgaaaccgacaacatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcgtcgcctggcctctctactgggccggccagggctgcgtcctaaccggcgtctggttcatatcccaccagtgcggccaccacgccatcagcgactac

SEQ ID NO: 29333 - DNA, 330 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcctacgagtgcggccaccacgccttcagcgactac

SEQ ID NO: 29334 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29335 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 29336 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactacgcctggcctctctactgggcctgccagggctgcgtccgaaccggcgtctgggtcatagcccacgagtgcggccaccacgccttcagcgacta

SEQ ID NO: 29337 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcttggtcatagcccacgagtgcggccaccacgccttcagcgactac

SEQ ID NO: 29338 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcataagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgcctgacccctctactgggcctgccaaggctgcgtcctaacgggcctctgggtcatagcccacgagtgcggccaccacgccttcagcgactac

SEQ ID NO: 29339 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagtgctgcgtcctaaccggcgtctgggtcatagcccacgagtgcggccaccacgccttcagcgactac

SEQ ID NO: 29340 - DNA, 350 bp, Artificial
  Mutation in BnaA.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29341 - DNA, 379 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggccacgatggcggcaacagccgctggagggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 29342 - DNA, 401 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgcccgccaccctccgggccgttgcttcacaacgttcaaatccgctcccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29343 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29344 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaattcggccaccacgccttcagcgactac

SEQ ID NO: 29345 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 29346 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagtaatcccaccgcactgtttcaaacgctcgatccctcgctctttctcctacctcatctgggacatcatcatagcctcctgcttctactacgtcgccaccacttacttccctctcctccctcaccctctcttctacttcgcctggcctctctactgggcctgccaaggctgcgtcctaacgggcctctgggtcatcgcccacgaatgcggccaccacgccttcagcgactac

SEQ ID NO: 29347 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29348 - DNA, 348 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 29349 - DNA, 363 bp, Artificial
  Mutation in BnaA.FAD2.a introduced by TALE nuclease pair BnFAD2_T03
caggatccatgggtgcaggtggaagaatgtaagtctctcctccctccagctcccccgaaaccaaaaccctcaaacgcgtcccctgcgagacaccacccttcactctcctttctttctggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29350 - DNA, 395 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtcccctgcgagacaccaccattcactctcggagagcgttcaccgacaaacaacagataaaacgacacacccagtcacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaggggtgcgtcctaacgggcctctgggtcatagcccacgagtgcggccaccacgccttcagcgactac

SEQ ID NO: 29351 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29352 - DNA, 357 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttttactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29353 - DNA, 277 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29354 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcaatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29355 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgttaggtacctcgcgaatgcatctagatccaattatcacgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 29356 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctggcctctctactgggcctgccagggctgcgtcctaaccggcgtctgggtcatagcccacgagtgcggccaccacgcctgcagcgactac

SEQ ID NO: 29357 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgattgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29358 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcaccgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccagggctgcgtcctaaccgacgtctgggtcatagcccacgagtgcggccaccacgccttcagcgactac

SEQ ID NO: 29359 - DNA, 348 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgatggcggccaccacgccttcagcgactac

SEQ ID NO: 29360 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagtgcgtaccctgcgagacaccgcccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29361 - DNA, 346 bp, Artificial
  Mutation in BnaA.FAD2.a introduced by TALE nuclease pair BnFAD2_T03
caggatccatgggtgcaggcggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccgtcagcgactac

SEQ ID NO: 29362 - DNA, 308 bp, Artificial
  Mutation in BnaA.FAD2.a introduced by TALE nuclease pair BnFAD2_T03
caggatccatgggtgcaggtggaagaatgcaagtgtctcctccctcccaaaagtctgaaaccgacaacatcaagaaagcaatcccaccgcactgtttcaaacgctcgatccctcgctctttctcctacctcatctgggacatcatcatagcctcctgcttctactacgtcgccatcacttacttccctctcctccctcaccctctctcctacttcgcctggcctctctactgggcctgccaagggtgcgtcctaaccggcgtctgggtcatagcccacaagtgcggccaccacgccttcagcgactac

SEQ ID NO: 29363 - DNA, 410 bp, Artificial
  Mutation in BnaA.FAD2.a introduced by TALE nuclease pair BnFAD2_T03
caggatccatgggtgcaggtggaagaatgcaagtgtctcatccctccaagaagtctgaaaccgacaacatcaagcgcgtaccctgcgagacaccaccattcactagttgccggtgctgtgccaggcccacggcttgaccccccagcaggtggtggccatcgccagcagacctcaagaaagcaatcccaccgcactgtttcaaacgctcgatccctcgctctttctcctacctcatctgggacatcatcatagcctcctgcttctactacgtcgccaccacgtacttccctctcctccctcaccctctctcctacttcgcctggcctctctactgggcctgccagggctgcggcctaaccggcgtctgggtcatagcccacgagtgcggccaccacgccttcagcgactac

SEQ ID NO: 29364 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctaccgggcctgccagggctgcgtcctaaccggcgtctgggtcatagcccacgagtgcggccaccacgccttcagcgactac

SEQ ID NO: 29365 - DNA, 295 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29366 - DNA, 408 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacggtccagcggctgttgccggtgctgtgccaggcccacggcttgaccccccagcaggtggtgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 29367 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccagggctgcgtcctaaccggcgtctgggtcatagcccacgagtgcggccaccacgccttcagcgactac

SEQ ID NO: 29368 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacacctcaaacgcgtcccctgcgagacaccaccattcactcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29369 - DNA, 308 bp, Artificial
  Mutation in BnaA.FAD2.a introduced by TALE nuclease pair BnFAD2_T03
caggatccatgggtgcaggtggaagaatgcaagtgcctactccatccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29370 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcacagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccgtcagcgactac

SEQ ID NO: 29371 - DNA, 377 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtcgtaatctggaacatcgtatgggtaatcgatgaccttacgtttaaactcaagaaagcaatcccaccgcactgtttcaaacgctcgatccctcgctctttctcctacctcatctgggacatcatcatagcctcctgcttctactacgtcgccaccacttacttccctctcccttccctcgcctgacccctctactgggcctgccaaggctgcgtcctaacgggcctctgggtcatagcccacgagtgcggccaccacgccttcagcgactac

SEQ ID NO: 29372 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccagcgtctgggtcatagcccacgagtgcggccaccacgccttcagcgactac

SEQ ID NO: 29373 - DNA, 407 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtggacaccaaggcctactccggcggctacaacctgcccatcggccaggccgacgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 29374 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29375 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 29376 - DNA, 418 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgttgtccagcggctgttgccggtgctgtgccaggcccacggcttgacccctcagcaggtggtggccatcggagaactcaagaaagcaatcccaccgcactgtttcaaacgctcgatcctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29377 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgtgcctgccagggctgcgtcctaaccggcgtctgggtcatagcccacgagtgcggccaccacgcctgcagcgactac

SEQ ID NO: 29378 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcttggtcatagcccacgagtgcggccaccacgccttcagcgactac

SEQ ID NO: 29379 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgcttcaaacgctcgatccctccctcttccccctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29380 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29381 - DNA, 327 bp, Artificial
  Mutation in BnaA.FAD2.a introduced by TALE nuclease pair BnFAD2_T03
caggatccatgggtgcaggtggaagaatgcaagtgtcttctcccttcaaaaagtctgaaaccgacaacatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctctctcaccctctctcctacttcgcctggcctctctactgggcctgccagggctgcgtcctaaccggcgtctggttcatagcccacgagggcggccaccacgcctccagcgactac

SEQ ID NO: 29382 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctccatccctcgctccttctcctacctcctcttcgacatcctcgtctcctcctccctctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 29383 - DNA, 409 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccccctggcttgaccccggagcaggtggtggccatcgccagccacgatggcggcaacagccgctggaccgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29384 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29385 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctccaacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29386 - DNA, 327 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29387 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcagtcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29388 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtcccctgcgagacaccacccttcactgagaactcacgaaagcaatcccaccgcactgtttcaaacgctcgatccctcgctctttctcctacctcttctgccacatcatcatcgcctcctgcttctactacgtcgccaccacctacttccctctcctccctcaccctctcccctacctcgcctggcctctctactgggcctgccagggctgcgtcctaaccggcgtctgggtcatagcccacgagtgcggccaccacgccttcagcgactac

SEQ ID NO: 29389 - DNA, 348 bp, Artificial
  Mutation in BnaA.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29390 - DNA, 452 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtcggtggccatcgccagcaataatggtggcaggtggtggccatcgccagcaatggcggtcgcaagcaagcgctggagaccgtccagcggctgttgccggtgcgagaactcaagaaagcaatcccaccgcactgtttcaaacgctcgatccctcgctctttctcctccctcatctgggacatcatcatagcctgctgcttttactacgtcgcccccacttacttccctctcctccctcaccctctctccttcttcgcctggcctctctactgggcctgccagggcggcgtcctaaccggcgtctgggtcttagcccacgagggcggccaccacgccgtcagccactac

SEQ ID NO: 29391 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccagggctgcgtcctaaccggcgtctgggtcatagcccacgagtgcggccaccacgccttcagcgactac

SEQ ID NO: 29392 - DNA, 345 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagacctcaagaaagcaatcccaccgcactgtttcaaacgctcgatccctcgctctttctcctacctcatctgggacatcatcatagcctcctgcttctactacgtcgccaccacttacttccctctcctccctcaacctctctcctacttctcctggcctctctactgggcctgccagggctgcgtcctcaccggcgtctgggtcatagcccacgagtgcggccaccacgccttcagcgactac

SEQ ID NO: 29393 - DNA, 339 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29394 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29395 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcctccgaaaccaaaaccctcaaacgcgtcccctgcgagacaccacccttcactcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29396 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 29397 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactcaacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcccctctactgggcctgccagggctgcgtcctaaccggcgtctgggtcatagcccacgagtgcggccaccacgcctgcagcgactac

SEQ ID NO: 29398 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactcaagaaagcaatcccaccgcactgtttcaaacgctcgatccctcgctctttctcctacctcatctggaacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 29399 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29400 - DNA, 429 bp, Artificial
  Mutation in BnaA.FAD2.a introduced by TALE nuclease pair BnFAD2_T03
gcaggatccatgggtgcaggtggaagaatgcaagtgtctcctccctccaaaaagtctgaaaccgacaacatcaagcgcttaccctgcgagacaccgcccttcactgttgcgcgtaaccaccacacccgccagcgccctagcgcccgctcctttcgctttcttcccttcctttctcgccacgttcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29401 - DNA, 346 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29402 - DNA, 347 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaacatcaagcgcgtaccctgcgagacaccgcccttcaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29403 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactttgctccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29404 - DNA, 318 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacagcccttactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29405 - DNA, 357 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29406 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29407 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcataagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcctggcctctctactgggcctgccaagggtgcgtcctaaccggcgtctgggtcatagcccgcgagtgcggccaccacgccttcagcgactac

SEQ ID NO: 29408 - DNA, 436 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaccccggagcaggtggtggccatcgccagcaatattggtggcaagcaggcgctggagacggtgcaggtggtggggtcaagccgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29409 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagtccacgagtgcggccaccacgccttcagcgactac

SEQ ID NO: 29410 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgttaggtacctcgcgaatgcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29411 - DNA, 436 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcacggtccagcggctgttgccggtgctgtgccaggcccacggcttgaccccccagcaggtggtggccatcgccagcaatggcggtggcacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 29412 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29413 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggcctctctactgggcctgccaagggtgcgtcctaacgggcctctgggtcatcgcccacgaattcggccaccacgccttcagcgactac

SEQ ID NO: 29414 - DNA, 348 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29415 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaaccctcgatccctcgctctttctcctacctcatctgggacatcatcatagcctcctgcttctactccgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 29416 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcacgactac

SEQ ID NO: 29417 - DNA, 324 bp, Artificial
  Mutation in BnaA.FAD2.a introduced by TALE nuclease pair BnFAD2_T03
caggatccatgggtgcaggtggaagaatgcaagtgtctactcccttcaaaaagtctgaaaccgacaacatcaagcgcgtaccctgcgggacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 29418 - DNA, 388 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcacccgtcagtgcattgcgccatgcatgcactgcctccagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29419 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccgtcagcgactac

SEQ ID NO: 29420 - DNA, 412 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgacggatggcctttttgcgtttctacaaactcttcctggctagcggtacgcgtattaattgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29421 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29422 - DNA, 349 bp, Artificial
  Mutation in BnaA.FAD2.a introduced by TALE nuclease pair BnFAD2_T03
caggatccatcggtgcaggtggaagaatgcaagtgtctcctccctccaaaaagtctgaaaccgacaccatcaagcgcgtcccctgcgagacaccgcccttcactgagaactcaagaaagcaatcccaccgcactcattcaaacgctcgatccctcgctctttctcctacctcatctgggacatcatcatagcctcctgcttctactacgtcgccaccgcttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29423 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccatcagcgactac

SEQ ID NO: 29424 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcagggctgcgtcctaaccggcgtctgggtcatagcccacgagtgcggccaccacgccttcagcgactac

SEQ ID NO: 29425 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccaccaatgcggccaccacgccttcagcgactac

SEQ ID NO: 29426 - DNA, 355 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttgctccaagaattcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgatac

SEQ ID NO: 29427 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgaactcaagaaagcaatcccaccgcactgtttcaagcgctcgatccctcgctctttctcctacctcatctgggacatcatcatagcctcctgcttctactacgtcaccaccacttacttccctctcctccctcaccctctctcctactgcgcctggcctctctactgggcctgccagggctgcggcctaaccggcgtctgggtcatagcccacgagtgtggccaccacgccttcagcgactac

SEQ ID NO: 29428 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcacctgggacatcatcatagccccctgcttctactacgtcgcccccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29429 - DNA, 320 bp, Artificial
  Mutation in BnaA.FAD2.a introduced by TALE nuclease pair BnFAD2_T03
caggatccaatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29430 - DNA, 308 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29431 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcgtagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 29432 - DNA, 393 bp, Artificial
  Mutation in BnaA.FAD2.a introduced by TALE nuclease pair BnFAD2_T03
caggatccatgggtgcaggttgaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29433 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacctggcctctctactgggcctgccagggctgcgtcctaaccggcgtctgggtcatagcccacgagtgcggccaccacgccttcagcgactac

SEQ ID NO: 29434 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtcctaaccggcgtctgggtcatagcccacgagtgcggccaccacgccttcagcgactac

SEQ ID NO: 29435 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29436 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgagtgcggccaccacgccttcagcgactac

SEQ ID NO: 29437 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgctagggctgcgtcctaaccggcgtctgggtcatagcccacgagtgcggccaccacgccttcagcgactac

SEQ ID NO: 29438 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 29439 - DNA, 326 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29440 - DNA, 370 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29441 - DNA, 338 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgctcacgaatgcggccaccacgccttcagcgactac

SEQ ID NO: 29442 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29443 - DNA, 340 bp, Artificial
  Mutation in BnaA.FAD2.a introduced by TALE nuclease pair BnFAD2_T03
caggatcctgggtgcaggtggaagaatgcaagtgtctcctccctccaagaagtctgaaaccgacaccatcaagcgcgtaccctgcgagacaccgcccttcactgtgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29444 - DNA, 341 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctccctactgggcctgccagggctgcgtcctaaccggcgtctgggtcatagcccacgagtgcggccaccacgccttcagcgactac

SEQ ID NO: 29445 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29446 - DNA, 348 bp, Artificial
  Mutation in BnaA.FAD2.a introduced by TALE nuclease pair BnFAD2_T03
caggatccattggtgcaggtggaagaatgcaagtgactcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggtctgccaagggtgcgtcctaaccggcgtctgggtcatagcccacgagtgcggccaccacgccatcagcgactac

SEQ ID NO: 29447 - DNA, 341 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29448 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 29449 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttgctccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29450 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29451 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgtgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29452 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggcttcgtcctaaccggcgtctgggtcatagcccacgagtgcggccaccacgccttcagcgactac

SEQ ID NO: 29453 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatatcccacgagtgcggccaccacgccttcagcgactac

SEQ ID NO: 29454 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcctctctactgggcctgccagggctgcgtcctaaccggcgtctgggtcatagcccacgagtgcggccaccacgccttcagcgactac

SEQ ID NO: 29455 - DNA, 349 bp, Artificial
  Mutation in BnaA.FAD2.a introduced by TALE nuclease pair BnFAD2_T03
caggatccatgggtgcaggtggaagaatgcaagtgtctcctccctccaggaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29456 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccaaggctgcgtcctaacgggcctctgggtcatcgcccacgaatgcggccaccacgccttcagcgactac

SEQ ID NO: 29457 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 29458 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccatctcctccctcaccctctctcctacttcgcctggcctctctactgggcctgccagggctgcgtcctaaccggcgtctgggtcatagcccacgagtgcggccaccacgccttcagcgactac

SEQ ID NO: 29459 - DNA, 380 bp, Artificial
  Mutation in BnaA.FAD2.a introduced by TALE nuclease pair BnFAD2_T03
caggatccatgggtgcaggtggaagaatgcaagtgtctcctccctccaacaagtctgaaaccgacaacatcaagcgcgtaccctgcgagacaccgcccttcactgtcgatggccaccacctgctccggggtcaagccgaactcaagaaagcaatcccaccgcactgcttcaaacgctcgatccctcgctctttctcctacctcatctggcacatcatcatagcctcctgcttctactacgtcgccacctcttacttccctcccctccctcaccctctctcctacctcgcctggcctctctactgggcctgccagggctgcgtcctaaccggcgtctgggtcatagcccacgagtgcggccaccacgccttcagcgactac

SEQ ID NO: 29460 - DNA, 350 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatggctgcgtcctaacctgcgtctgggtcatagcccgcgagtgcgtccaccacgccttcagcgactac

SEQ ID NO: 29461 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 29462 - DNA, 447 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccccagcaggtggtggccatcgccagcaataatggtggcaagcaggcgctggagacggtgctgtgccaggcccacggcttgaccccccagcaggtggtggccatcgccagcaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29463 - DNA, 351 bp, Artificial
  Mutation in BnaA.FAD2.a introduced by TALE nuclease pair BnFAD2_T03
caggatccatgggtgcaggtggcagaatgcaagtctctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 29464 - DNA, 350 bp, Artificial
  Mutation in BnaA.FAD2.a introduced by TALE nuclease pair BnFAD2_T03
caggatccatgggtgcaggtggaagaatgcatgtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29465 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctggatcatcgcccacgaatgcggccaccacgccttcagcgactac

SEQ ID NO: 29466 - DNA, 389 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcttcaagtatgacgggctgatactgggccggcaggcgctccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcttgccaagggtgcgtcctaaccggcgtcggggtcatagcccacgagtgcggccaccacgccttcagcgactac

SEQ ID NO: 29467 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcacccactctcctacttcgcctggcctctctactgggcctgccaagggtgcgtcctaaccggcgtctgggtcatagcccacgagtgcggccaccacgccttcagcgactac

SEQ ID NO: 29468 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 29469 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgctagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 29470 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29471 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29472 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29473 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29474 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagtccacgagtgcggccaccacgccttcagcgactac

SEQ ID NO: 29475 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcacctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29476 - DNA, 373 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacattaaccagctgcattaatgaatcggccaactcaagaaagcaatcccaccgcactgtttcaaacgctcgatccctcgctctttctcctacctcatctgggacatcatcatagcctcctgcttctactacgtcgccaccacttacttccctcgcctcccccaccctctcccttacctcgcctggcccctctactgggcctgccaaggctgcgtcctaacgggcctctggttcatcgcccacgaatgcggccaccacgccttcagcgactac

SEQ ID NO: 29477 - DNA, 333 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 29478 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcatacttcgcctggcctctctactgggcctgccagggctgcgtcctaaccggcgtctgggtcatagcccacgagtgcggccaccacgccttcagcgactac

SEQ ID NO: 29479 - DNA, 350 bp, Artificial
  Mutation in BnaA.FAD2.a introduced by TALE nuclease pair BnFAD2_T03
caggatccatgggtgcaggtggaagaatgcaagtgtctcctccctctaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29480 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 29481 - DNA, 277 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgagacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29482 - DNA, 382 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacagccgctggaccgtctccagcgcctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaaccggcgtctgggtcatagcccacgagtgcggccaccacgccttcagcgactac

SEQ ID NO: 29483 - DNA, 350 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 29484 - DNA, 372 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgctcacatgttctttcctgcgttatcccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29485 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcacgcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcagagcccaccagtgcggccaccacgcctgcagcgactac

SEQ ID NO: 29486 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 29487 - DNA, 344 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 29488 - DNA, 350 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctgaccggcgtctgggtcatagcccacgagtgcggccaccacgccttcagcgactgc

SEQ ID NO: 29489 - DNA, 350 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29490 - DNA, 380 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29491 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaattcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 29492 - DNA, 462 bp, Artificial
  Mutation in BnaA.FAD2.a introduced by TALE nuclease pair BnFAD2_T03
caggatccatgggtgcaggtggaagaatgcaagtgtctcctccctccaagaagtcttaaaccgacaccatcaagcgcgtaccctgcgagacaccgcccttcactgtcgccataaactgccaggcatcaaactaagcagaaggccatccgtctccagcgcctgcttgccaccgccattgccaggcccacggcttgaccccccagcaggtggtggccattagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29493 - DNA, 344 bp, Artificial
  Mutation in BnaA.FAD2.a introduced by TALE nuclease pair BnFAD2_T03
caggatccatgggtgcaggtgccagaatgcaagtgtatactccctccaaaaagtctgaaaccgacaacatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29494 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgacta

SEQ ID NO: 29495 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcccttacctcgcctggcccctctactgggcctgccaaggctgcgtcctaacgggcctctgggtcatcgcccacgaatgcggccaccacgccttcagcgactac

SEQ ID NO: 29496 - DNA, 329 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29497 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 29498 - DNA, 304 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29499 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29500 - DNA, 452 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggtggccatcgccagcaataatggtggcaggtggtggccatcgccagcaatggcggtggcaagcaggcgctggagacggtccagcggctgttgccggtgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29501 - DNA, 349 bp, Artificial
  Mutation in BnaA.FAD2.a introduced by TALE nuclease pair BnFAD2_T03
caggatccatgggtgcaggtggcagaatgcaagtgtctactccctccaaaaagtctgaaaccgacaccatcaagcgcgtaccctgcgagacaccgcccttcactgtaaactcaagcaagcaatcccaccgcactgtttcaaacgcacgatccctcgctctttctcctacctcatctgggacagcatcatagcctcctgcttctactacgtcgccaccacttacttccctctcctccctcaccctctctcctactgcgcctggcctctctactgggcctgccagggctgcggcctaacgggcgacggggtcatagcccacgtgttcggccaccacgcctacagcgactac

SEQ ID NO: 29502 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcgaacgctcgatccctcgctctttctcctacctcatctgggacatcatcatagcctcctgcttctactacgtcgccaccacttacttccctctcctccctcacactctctcctacttcgcctggcctctctactgggcctgccagggctgcgtcctaaccggcgtctgggtcatagcccacgagtgcggccaccacgccttcagcgactac

SEQ ID NO: 29503 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 29504 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcccacttcgcctggcctctctactgggcctgccaaggctgcgtcctaacgggcctctgggtcatagcccacgagtgcggccaccacgccttcagcgactac

SEQ ID NO: 29505 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactaagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29506 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagtaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 29507 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29508 - DNA, 345 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 29509 - DNA, 342 bp, Artificial
  Mutation in BnaA.FAD2.a introduced by TALE nuclease pair BnFAD2_T03
caggatccatgggtgcaggtggcagaatgcaagtgtctactccctccaaaaagtctgaaaccgacaacctcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 29510 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacttcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 29511 - DNA, 398 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggcgactgccctgctgcgtaacatcgttgctgctccataacatcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaaccggcgtctgggtcatagcccacgagtgcggccaccacgccttcagcgactac

SEQ ID NO: 29512 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctgagacctcaagagagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29513 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagggcggccaccacgcctgcagcgactac

SEQ ID NO: 29514 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 29515 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29516 - DNA, 421 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcggcctacaccgctgtgaagtgctccaccccgtaggtcggataaggcggttacgccttatccaacctacggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29517 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccgatctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 29518 - DNA, 333 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcggcctaacgggcctctgggtcatagcccacgagtgcggccaccacgccttcagcgactac

SEQ ID NO: 29519 - DNA, 308 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccactagtgcggccaccacgccttcagcgactac

SEQ ID NO: 29520 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagccaccgcccttcactgaactcaagaaagcaatcccaccgcactgtttcaaacgctaaatccctcgctctttctcctacctcatctgggacatcatcatagcctcctgcttctactacgtcgccaccacttacttccctctcctccctcaccctctctcctacttcgcctggcctctctactgggcctgccacggctgcgtcctaaccggcgtctgggtcatagcccacgagtgcggccaccacgccttcagcgactac

SEQ ID NO: 29521 - DNA, 348 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 29522 - DNA, 315 bp, Artificial
  Mutation in BnaA.FAD2.a introduced by TALE nuclease pair BnFAD2_T03
caggatccatgggtgcaggtggaagaatgcaagtctctcctccctcccgtccccccggaaacaacaccctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29523 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 29524 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttcttccaccgtactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 29525 - DNA, 337 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29526 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaaacgcgtaccctgcgagacaccgcccttcactttgctccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaatcggcgtctgggtcatagcccacgagtgcggccaccacgccttcagcgactac

SEQ ID NO: 29527 - DNA, 332 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 29528 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgtgagacaccacccttcactctagacctcaataaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29529 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 29530 - DNA, 385 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggtcagggtgccggccttgatcatctcgccgccagaacccaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29531 - DNA, 345 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29532 - DNA, 342 bp, Artificial
  Mutation in BnaA.FAD2.a introduced by TALE nuclease pair BnFAD2_T03
catgatccatgggtgcaggtggaagaatgcaagtctctcctccctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29533 - DNA, 341 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29534 - DNA, 342 bp, Artificial
  Mutation in BnaA.FAD2.a introduced by TALE nuclease pair BnFAD2_T03
caggatccatgggtgcaggtgtaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29535 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggacctgccaaggctgcgtcctaaccggcgtctgggtcatagcccacgagtgcggccaccacgccttcagcgactac

SEQ ID NO: 29536 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggctaccacgccttcagcgactac

SEQ ID NO: 29537 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaccatcaagcgcgtaccctgcgagacaccgcccttcactctagaactcaagaaagcaatcccaccgcactgcttcaaacgctcgatccctcgctctttctcctccctcacctggcacatcttcataccctccttcctctactacgtcgcccccacctacttccctcccctccctccccctctcccctacttcgcctggcctctctactgggcctgccagggctgcgtcctaaccggcgtctgggtcatagcccacgagtgcggccaccacgccttcagcgactac

SEQ ID NO: 29538 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccaccgcactgtttcaaacgctcgatccctcgctctttctcctacctcatctgggacatcatcatatcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29539 - DNA, 349 bp, Artificial
  Mutation in BnaA.FAD2.a introduced by TALE nuclease pair BnFAD2_T03
caggatccatgggtgcaggtggaagaatgcaagagtctcgtccctccaaaaagtctgaaaccgacaacatcaagcgagtacccccagcaggtggtgaccatcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactggtcctgccagggcttcgtcctaaccggcgtctgggtcatagcccccgagggcggccaccacgcctacagcgactac

SEQ ID NO: 29540 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctcaccggcgtctgggtcatagcccacgagtgcggccaccacgccttcagcgactac

SEQ ID NO: 29541 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctagatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29542 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcatctctactgggcctgccagggctgcgtcctaaccggcgtctgggtcatagcccacgagtgcggccaccacgccttcagcgactac

SEQ ID NO: 29543 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagcgctgcgtcctaaccggcgtctgggtcatagcccacgagtgcggccaccacgccttcagcgactac

SEQ ID NO: 29544 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaataaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29545 - DNA, 355 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcttctctactgggcctgccagggctgcgtcctaacgggcctctgggtcatcgcccacgaatgcggccaccacgccttcagcgactac

SEQ ID NO: 29546 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29547 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgttgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29548 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29549 - DNA, 396 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggttcctggccttttgctggccttttgctcacatgttctttccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29550 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagccgactac

SEQ ID NO: 29551 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggttcatagcccacgagtgcggccaccacgccttcagcgactac

SEQ ID NO: 29552 - DNA, 350 bp, Artificial
  Mutation in BnaA.FAD2.a introduced by TALE nuclease pair BnFAD2_T03
caggatccatgggtgcaggtggaagaatgcaagtctctcctccctccaagaagcctgaaaccgacaccctcaagcgcgtaccctgcgagacaccgcccttcactgtcgaactcatgaaagcaatcccaccgcactgcttcaaacgatccatccctcgctctttctcctacctcatctctgacatcatcatagcctcctgcttctactaccccgccaccacctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29553 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctgcgagaactcaagaaagcaatccccccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgtgtcatagcccacgagtgcggccaccacgccttcagcgactac

SEQ ID NO: 29554 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttctgcgactac

SEQ ID NO: 29555 - DNA, 413 bp, Artificial
  Mutation in BnaA.FAD2.a introduced by TALE nuclease pair BnFAD2_T03
caggatccatgggtgcaggtggaataatgcaagtgtctcctccctccaagaagtctgaaaccgacaccatcaagcgcgtaccctgcgagacaccgcccttcactgtcggccatcgccagcaatggcggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29556 - DNA, 337 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctccttctcctcttcgacatcatcatctcctcctcggctcctccctctaccacctctccacagcctacttccctctcccttacctcgcctggcctctctactgggcctgccaaggctgcgtcctaacgggcctctgggtcatagcccacgagtgcggccaccacgccttcagcgactac

SEQ ID NO: 29557 - DNA, 349 bp, Artificial
  Mutation in BnaA.FAD2.a introduced by TALE nuclease pair BnFAD2_T03
caggatccatgggtgcaggtggcagaacgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29558 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcatcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29559 - DNA, 358 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccttcactgtcgtggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29560 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctctcaagaaagcaatcccaccgcactgtttcaaacgctcgatccctcgctctttctcctacttcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29561 - DNA, 347 bp, Artificial
  Mutation in BnaA.FAD2.a introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcactcacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29562 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 29563 - DNA, 430 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgaaacaccgcccttccatttggtacaccgccctacaccgcccttcacacgcccgccataaactgccaggcatcaaactaagcagaaggccatcctgacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29564 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctcggcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29565 - DNA, 347 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29566 - DNA, 347 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29567 - DNA, 360 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 29568 - DNA, 337 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 29569 - DNA, 350 bp, Artificial
  Mutation in BnaA.FAD2.a introduced by TALE nuclease pair BnFAD2_T03
caggatccattggtgcaggtggaagaatgcaagtgtctcctccctccaagaagtctgaaaccgaaaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29570 - DNA, 350 bp, Artificial
  Mutation in BnaA.FAD2.a introduced by TALE nuclease pair BnFAD2_T03
caggatccatgggtgcaggtggaagaatgcaagtctctcctccctccaactcctctgaaaccgacaccctcaagcgcgtaccctgcgagacaccgcccttcactgtcgaactcatcaaagcaatcccaccgcactgtttcaaacgctcgatccctcgctctttctcctacctcatctgggacatcatcatagcctcctgcttctactacgtcgcccccacttacttccctctcctccctcgccctctctcctacttcgcctggcctctctactgggcctgccagggctgcgtcctaaccggcgtctgggtcatagcccacgagtgcggccaccacgccttcagcgactac

SEQ ID NO: 29571 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccattcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcgcgactac

SEQ ID NO: 29572 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcagcatagcctcctgcttctactacgtcgccaccacgtacttccctctcctccctcaccctctctcctgcttcacctggcctctctactgggcctgccagggctgcgtcctaaccggcgtctgggtcatagcccacgagtgcggccaccactccttcagcgactac

SEQ ID NO: 29573 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccatcaaacgcgtcccctgcgagacctcaagaaagcaatcccacctcactgcttcaaacgctccatcccgcgctccttctcctacctcatctgggacatcatcatagcctcctgcttctactacgtcgccaccacttacttccctctcctccctcaccctctctcctacgtcgcctggcctctctactgggcctgccagggctgcgtcctaaccggcgtctgggtcatagcccacgagtgcggccaccacgccttcagcgactac

SEQ ID NO: 29574 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcataaccggcgtctgggtcatagcccacgagtgcggccaccacgccttcagcgactac

SEQ ID NO: 29575 - DNA, 308 bp, Artificial
  Mutation in BnaA.FAD2.a introduced by TALE nuclease pair BnFAD2_T03
caggatccatgggtgcaggtggaagaatgcaagtgtctccaccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29576 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 29577 - DNA, 348 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29578 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29579 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29580 - DNA, 373 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactgccaggcatcaaactaagcagaaggccatccgtcaaacgctcaagaaagcaatcccaccgcactgtttcaaacgctcgatccctcgctctttctcctacctcatctgggacatcatcatagcctcctgcttctactacgtcgccaccacttacttcccgctcctccctcaccctctctcctacttcgcctggcctctctactgggcctgccagggctgcgtcctaaccggcgtctgggtcatagcccacgagtgcggccaccacgccttcagcgactac

SEQ ID NO: 29581 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgagtgcggccaccacgccttcagcgactac

SEQ ID NO: 29582 - DNA, 350 bp, Artificial
  Mutation in BnaA.FAD2.a introduced by TALE nuclease pair BnFAD2_T03
caggatccatggttgcaggtggaataatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgccctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29583 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttccctcgcctggcccctctactgggcctgccaagggtgcgtcctaaccggcgtcttggtcatagcccacgagtgcggccaccacgccttcagcgactac

SEQ ID NO: 29584 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctatcacctctccacagcctacttccctctcctcccccaccctctctcctacttcgcctggcctctctactgggcctgccaagggtgcgtcctaacgggcctctgggtcatagcccacgagtgcggccaccacgccttcagcgactac

SEQ ID NO: 29585 - DNA, 350 bp, Artificial
  Mutation in BnaA.FAD2.a introduced by TALE nuclease pair BnFAD2_T03
caggatccatgggtgcaggtggaagaatgcaagtgtatactccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29586 - DNA, 360 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29587 - DNA, 350 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 29588 - DNA, 317 bp, Artificial
  Mutation in BnaA.FAD2.a introduced by TALE nuclease pair BnFAD2_T03
caggatccatgggtgcaggtggaataatgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29589 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcaggactac

SEQ ID NO: 29590 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29591 - DNA, 422 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgctagacaccgcccttcactgtcggcaagcaggcgctggagacggtccagcggctgttgccggtgctgtgccaggcccactgcttgaccacggcagaactcaagaaatcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29592 - DNA, 433 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggcggtggcaagcaggcgctggagacggtccagcggctgttgccggtgctgtgccaggcccacggcttgaccccccagcaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29593 - DNA, 340 bp, Artificial
  Mutation in BnaA.FAD2.a introduced by TALE nuclease pair BnFAD2_T03
caggatccatgggtgcaggtggcagaatgcaagtgtctcctccctccaaaaagtctgaaaccgacaacatcaagcgcgtaccctgcgagacaccgcccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29594 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttgcctctctactgggcctgccagggctgcgtcctaaccggcgtctgggtcatagcccacgagtgcggccaccacgccttcagcgactac

SEQ ID NO: 29595 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccagggctgcgtcctaaccggcgtctgggtcatagcccacgagtgcggccaccacgccttcagcgactac

SEQ ID NO: 29596 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgtgtgcggccaccacgccttcagcgactac

SEQ ID NO: 29597 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29598 - DNA, 349 bp, Artificial
  Mutation in BnaA.FAD2.a introduced by TALE nuclease pair BnFAD2_T03
caggatccatgggtgcaggtggcataatgcaagtgtctcctccctccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29599 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 29600 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29601 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtcccctgcgagacaccacccttcactccagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29602 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagttcggccaccacgccttcagcgactac

SEQ ID NO: 29603 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgctagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29604 - DNA, 357 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29605 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29606 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagtccacgagtgcggccaccacgccttcagcgactac

SEQ ID NO: 29607 - DNA, 357 bp, Artificial
  Mutation in BnaA.FAD2.a introduced by TALE nuclease pair BnFAD2_T03
caggatccatgggtgcaggtggcagaatgcaagtgtctcctccctccaagaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 29608 - DNA, 398 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtcgggcgactgccctgctgcgtaacatcgttgctgctccataacatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29609 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 29610 - DNA, 346 bp, Artificial
  Mutation in BnaA.FAD2.a introduced by TALE nuclease pair BnFAD2_T03
caggatccatgggtgcagggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcccctggcccctctactgggcctgccaaggctgcgtcctaacgggcgtctgggtcatagcccacgagtgcggccaccacgccttcagactac

SEQ ID NO: 29611 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29612 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcgcgactac

SEQ ID NO: 29613 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29614 - DNA, 431 bp, Artificial
  Mutation in BnaA.FAD2.a introduced by TALE nuclease pair BnFAD2_T03
caggatccatgggtgcaggtggaagaatgcaagtgtctcctccctccaaaaagtctgaagccgacaacatcaagcgcgtaccctgcgagacaccgcccttcactgtcggcgcgaacgtggcgagaaaggaagggaagaaagcgaaaggagcgggcgctagggcgctggcaagtgtagtggttacgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29615 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtatgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29616 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaccatcaagcgcgtaccctgcgagacaccgcccttcgctaactcaaaacagcaatcccaccgcactgttccaaacgctcgatccctcactctttctcctacctcatcttcgacatcatcatagcctcctgcctctactacgccgccaccacctacttccctctcccccctcaccctctctcctacttcgcctggcctctctactgggcctgccaaggctgcgtcctaaccggcgtctgggtcatagcccacgagtgcggccaccacgccttcagcgactac

SEQ ID NO: 29617 - DNA, 318 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgccctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29618 - DNA, 447 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccccagcaggtggtggccatcgccagcaataatggtggcaagcaggcgctggagacggtgctgtgccaggcccacggcttgaccccccagcaggtggtggccctcgccagcaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29619 - DNA, 422 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgtggataaccgtattaccgcctttgagtgagctgataccgctcgccgcagccgaacgaccgagcgcagcgagagaactcaagaaagcaatcccaccgcactgtttcaaacgctcgatccctcgctctttctcctacctcatctgggccatcatcatagcctcctgcttctactacgtcgccaccacttacttcccgctcctccctcaccctctctcctacttcgcctggcctctctactgggcctgccaagggtgcgtcctaacgggcctctgggtcatagcccacgagtgcggccaccacgcctgcagcgactac

SEQ ID NO: 29620 - DNA, 271 bp, Artificial
  Mutation in BnaA.FAD2.a introduced by TALE nuclease pair BnFAD2_T03
caggatccatgggtgcaggtggaagaatgcaagtgtctcctccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29621 - DNA, 279 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgggacatcatcatagcctcctgcttctactacgtcgccaccacttacttcccctcctccctcaccctctctcctacttcgcctggcctctctactgggcctgccagggctgcgtcctaaccggcgtctgtgtcatagcccacgagtgcggccaccacgccttcagcgactac

SEQ ID NO: 29622 - DNA, 383 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtaacgaccttttggaaacttcggcttcccctgaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29623 - DNA, 397 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgagcaggtggtggccatcgccagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 29624 - DNA, 349 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29625 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 29626 - DNA, 350 bp, Artificial
  Mutation in BnaA.FAD2.a introduced by TALE nuclease pair BnFAD2_T03
caggatccatgggtgcaggtgaaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29627 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggtccctctactgggcctgccaaggctgcgtcctaacgggcctctgggtcatcgcccacgaatgcggccaccacgccttcagcgactac

SEQ ID NO: 29628 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtcataaaccgacaacatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29629 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggacctgccagggctgcgtcctaaccggcgtctgggtcatagcccacgagtgcggccaccacgccttcagcgactac

SEQ ID NO: 29630 - DNA, 343 bp, Artificial
  Mutation in BnaA.FAD2.a introduced by TALE nuclease pair BnFAD2_T03
caggatccatgggtgcaggtggaagaatgcaagtgtcacctccctccaaaaagtctgaaaccgacaacatcaagcgcgtaccctgcgagacaccgcccttcactgtttggaagcaaccccaccgcactgtttcaaacgctcgatccctcgctctttctcctacctcatctggcacatcatcatagcctcctgcttctactacgtcgcaaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29631 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29632 - DNA, 356 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29633 - DNA, 415 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcccacggcttgaccccggagcaggtggtggccatcgccagccacgctggcggcaacagccgctggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29634 - DNA, 345 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29635 - DNA, 347 bp, Artificial
  Mutation in BnaA.FAD2.a introduced by TALE nuclease pair BnFAD2_T03
caggatccatgggtgcaggtgcaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29636 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 29637 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgtttcaaacgctcgatccctcgctctttctcctacctcatctgggacatcatcatagcctcctgcttctactacgtcgccaccacctacttccctctcctccctcaccctctcccctacttcgcctggcctctctactgggcctgccagggctgcgtcctaaccggcgtctgggtcatcgcccacgagtgcggccaccacgccttcagcgactac

SEQ ID NO: 29638 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29639 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccccctccctctctcctacttcgcctggcctctctactgggcctgccaaggctgcgtcctaacgggcctctgggtcatagcccacgagtgcggccaccacgccttcagcgactac

SEQ ID NO: 29640 - DNA, 348 bp, Artificial
  Mutation in BnaA.FAD2.a introduced by TALE nuclease pair BnFAD2_T03
caggatccatgggtgcaggtggaagaatgcaagtgtctcctccttccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggcctgcgtcctaacgggcctctgggtcatagcccacgagtgcggccaccacgccatcagcgactac

SEQ ID NO: 29641 - DNA, 423 bp, Artificial
  Mutation in BnaA.FAD2.a introduced by TALE nuclease pair BnFAD2_T03
caggatccatgggtgcaggtggaagaatgcaagtgtctcctacctccaagaagtctgaaaccgacaccatcaagcgcgtaccctgcgagacaccgcccttcactgtcggcgatggccaccacctgctccggggtcaagccgtgggcctggtacagcaccggcaacagccgctggagactagaactcaagaaagcaatcccaccgcactgtttcaaacgctcgatccctcgctctttctcctacctcatctgggacatcatcatagcctcctgcttctactacgtcgccaccacttacttccctctcctccctcaccctcgctcctacttcgcctggcctctctactgggcctgccagggctgcgtcctaaccggcgtctgggtcatagcccacgagtgcggccaccgcgccttcagcgactac

SEQ ID NO: 29642 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactcaagaaagcaatcccaccgcactgtttcaaacgctcgatacctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 29643 - DNA, 308 bp, Artificial
  Mutation in BnaA.FAD2.a introduced by TALE nuclease pair BnFAD2_T03
caggatgcatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29644 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatcactcgctctttctcctacctcatctgggacatcatcatagcctcctgcttctactacgtcgccacctcttacttccctctcctccctcaccctctctccgtcttcgcctggcctctctactgggcctgccagggctgcgtcctaaccggcgtctgggtcatagcccacgagtgcggccaccacgccgtcagcgactac

SEQ ID NO: 29645 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29646 - DNA, 350 bp, Artificial
  Mutation in BnaA.FAD2.a introduced by TALE nuclease pair BnFAD2_T03
caggatccatgggtgcaggcggaagcatgcaagtgtctcctccctcccaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29647 - DNA, 363 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaaaaactcttggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29648 - DNA, 354 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcattgcctcctgcttctactacgtcgccaccacttacttccctctcctccctcaccctctctcctacttcgcctgacccctctactgggcctgccagggctgcgtcctaaccggcgtctgggtcatagcccacgagtgcggccaccacgccttcagcgactac

SEQ ID NO: 29649 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcccctggcctctctacggggcctgccggggctgcgtcctaaccggcgtctgggtcatagcccacgagtgcggccaccacgccttcagcgactac

SEQ ID NO: 29650 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29651 - DNA, 372 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgctcacatgttctttcctgcgttatcccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29652 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtccgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29653 - DNA, 350 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29654 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggaactcaagaaagcaatcccaccgcactgtttcaaacgctcgatccctcgctctttctcctacctcaactgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29655 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaagcgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29656 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccccccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtctggcctctctactgggcctgccagggctgcgtcctaaccggcgtctgggtcatagcccacgagtgcggccaccacgccttcagcgactac

SEQ ID NO: 29657 - DNA, 315 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctcttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29658 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggtccctctactgggcctgccaaggctgcgtcctaacgggcgtctgggtcatagcccacgagtgcggccaccacgccttcagcgactac

SEQ ID NO: 29659 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29660 - DNA, 359 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggatcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccaagagtgcggccaccacgccttcagcgactac

SEQ ID NO: 29661 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgacac

SEQ ID NO: 29662 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagttcgtccaccacgccttcagcgactac

SEQ ID NO: 29663 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtccgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactac

SEQ ID NO: 29664 - DNA, 350 bp, Artificial
  Mutation in BnaA.FAD2.a introduced by TALE nuclease pair BnFAD2_T03
caggatccatggggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29665 - DNA, 349 bp, Artificial
  Mutation in BnaA.FAD2.a introduced by TALE nuclease pair BnFAD2_T03
aggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29666 - DNA, 309 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaaccgacaacacccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 29667 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctacgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 29668 - DNA, 348 bp, Artificial
  Mutation in BnaA.FAD2.a introduced by TALE nuclease pair BnFAD2_T03
caggatccatgggtgcaggtgggagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctccctcctacttcgcctggcctctctactgggcctgccagggctgcgtcctaaccggcgtctgggtcatagcccacgagtgcggccaccacgccttcagcgactac

SEQ ID NO: 29669 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcataccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29670 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagctcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29671 - DNA, 364 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgacggagaactcaagaaagcaatcccaccgcactgtttcaaacgctcgatccctcgctctttctcctacctcatctgggacatcatcatctcctcctcggctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 29672 - DNA, 328 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaatatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactacc

SEQ ID NO: 29673 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcctctctactgggcctgccagggctgcgtcctaaccggcgtctgggtcatagcccacgagtgcggccaccacgccttcagcgactac

SEQ ID NO: 29674 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccagggctgcgtcctaaccggcgtctgggtcatagcccacgagtgcggccaccacgccttcagcgactac

SEQ ID NO: 29675 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactac

SEQ ID NO: 29676 - DNA, 324 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 29677 - DNA, 349 bp, Artificial
  Mutation in BnaA.FAD2.a introduced by TALE nuclease pair BnFAD2_T03
gaggagaaaagggagaaggtggaagaaaggaagcgtctcctccaaccaagaagggggaaaccgacaacatcaagcgcggagactgcgagacacggaagatcactgagaactcaagaaagcaatcccaccgcactgttgcaaacgcacgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 29678 - DNA, 371 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttttgacggggtcagtgccttaagtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29679 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaaaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccatcagcgactac

SEQ ID NO: 29680 - DNA, 351 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29681 - DNA, 389 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggtttgtttgccggatcaagagctaccaactctttttccgaagaactcaagaaagcaatcacaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtaatagcccacgagtgcggccaccacgccttcagcgactac

SEQ ID NO: 29682 - DNA, 395 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggtggccatcgccagcaatggcggtggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29683 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtacactgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29684 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccgtagacctcaagaaagcaatcccacctcactgcttcaaacgctccatcccacgctccttctcctcttcgacatcatcatctcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29685 - DNA, 397 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggatggccttctgcttagtttgatgcctggcagtttatggcgggcatactcaagaaagcaaacccaccccactgtttcaaacgctccaccccacgccccttctcctcttcgacatcatcatctcctccccggctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29686 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgattgtggccaccacgccttcagcgactac

SEQ ID NO: 29687 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29688 - DNA, 314 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 29689 - DNA, 406 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggctggcgatggccaccacctgctggggggtcaagccatgggcctggcacagcaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29690 - DNA, 354 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgggaagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29691 - DNA, 333 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactc

SEQ ID NO: 29692 - DNA, 319 bp, Artificial
  Mutation in BnaA.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29693 - DNA, 340 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgttcggctgcggcgagcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 29694 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 29695 - DNA, 382 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtcccctgcgagacaacaccatcaacatcgtggctggcgatggccaccacctgtgccaggcccacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29696 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 29697 - DNA, 410 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggatcagggcgagataactgggcaacaatgctctccagcgccggcctgccgccgccattgagacctcaagaaagcaatcccaccgcactgtttcaaacgctcgatccctcgctctttctcctacctcatctgggacatcatcatagcctcctgcttctactacgtcgccaccacttacttcccgctcctccctcaccctctctcctacttcgcctggcctctctactgggcctgccagggctgcgtcctaaccggcgtctgggtcatagcccacgagtgcggccaccacgccttcagcgacta

SEQ ID NO: 29698 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29699 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccacactgtttcaaacgctcgatccctcgctctttctcctacctcatctgggacatcatcatagcctcctgcctctactacgtcgccaccacctacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29700 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29701 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 29702 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcgagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29703 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29704 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtccgaaccggcgtctgggtcatagcccacgagtgcggccaccacgccttcagcgactac

SEQ ID NO: 29705 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacctccctccaagtgtctcctccctcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 29706 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29707 - DNA, 358 bp, Artificial
  Mutation in BnaA.FAD2.a introduced by TALE nuclease pair BnFAD2_T03
caggatccatgggtgcaggtggaagaatgcaagtgcctcctccctccaaaaagtctgaaaccgacaacatcaagcgcgtaccctgcgagacaccgcccttcactgtcggggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29708 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29709 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaaccggatcaaagagttcctccgccgctggacctaccaaggcaacgctatgttctaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 29710 - DNA, 411 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaggtcttgaccccggagcaggtggtggccatcgccagccacgatggcggcaagcaggcgctggagaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29711 - DNA, 457 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagcaacaggagaagatcaaaccgaaggttcgttcgacagtggcgcagcaccacgagtcaggatggccttctgcttagtttgatgcctggcagtttatggcgggcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29712 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctggatccctcgctctttctcctacctcatctggcacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29713 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctaaccctctctcctacttcgcctggcctctctactgggcctgccagggctgcgtcctaaccggcgtctgggtcatagcccacgagtgcggccaccacgccttcagcgactac

SEQ ID NO: 29714 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggtctctctactgggcctgccagggctgcgtcctaaccggcgtctgggtcatagcccacgagtgcggccaccacgccttcagcgactac

SEQ ID NO: 29715 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcctctctactgggcctgccaaggctgcgtcctaacgggcctctgggtcatcgcccacgaatgcggccaccacgccttcagcgactac

SEQ ID NO: 29716 - DNA, 393 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29717 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtcataaaccgacaacctcaagcgcgtacccccagcaggtggtgaccatcgccagaactcaagaaagcaatcccaccgcactgtttcaaacgctcgatccctcgctctttctcctacctcatctgcgacatcatcatagcctcctgcttctactacgtcaccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 29718 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29719 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29720 - DNA, 308 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaacatcaagcgcgtaccctgcgagacactggagacggtctcgatccctcgctctttctcctacctcatctgggacatcatcatagcctcctgcttctactacgtcgccaccgcttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 29721 - DNA, 307 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgcaagggtgcgtcctaaccggcgtctgggtcatagcccacgagtgcggccaccacgccttcagcgactac

SEQ ID NO: 29722 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatggcccacgagtgcggccaccacgccttcagcgactac

SEQ ID NO: 29723 - DNA, 331 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29724 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29725 - DNA, 360 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29726 - DNA, 350 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29727 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccgaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29728 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcttcatagcctcctgcttctactacgtcgccaccacctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29729 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 29730 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccaagggtgcgtcctaaccggcgtctgggtcatagcccacgagtgcggccaccacgccttcagcgactac

SEQ ID NO: 29731 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcatcctctctcctacttcgcctggcctctctactgggcctgccaagggtgcgtcctaaccggcgtctgggtcatagcccacgagtgcggccaccacgccttcagcgactac

SEQ ID NO: 29732 - DNA, 305 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccctcaagaaagcaatcccaccgcactgtttcaaacgctcgatccctcgctccttctcctacctcctcttcgacatcctcgtctcctcctccctcaccctctctcctacttcgcctggcctctctactgggcctgccagggctgcgtcctaaccggcgtctgggtcatagcccacgagtgcggccaccacgccttcagcgactac

SEQ ID NO: 29733 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttcccctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29734 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgcgcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29735 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccattaagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29736 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctccttcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29737 - DNA, 277 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29738 - DNA, 469 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagccgctggaccgtctccagcgcctgcttgccaccgccattgctggcgatggccaccacctgctggggggtcaagccgtgggcctggcacagcaccggcaacagccgctggagatcggagaactcaagaaagcaatcccaccgcactgtttcaaacgctcgatccctcgctctttctcctacctcagctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29739 - DNA, 369 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaccatcaagcgcgtaccctgcgagacaccgcccttcactgtacggtggtttgtttgccggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 29740 - DNA, 436 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgggcttgaccccccagcaggtggtggccatcgccagcaataatggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29741 - DNA, 308 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29742 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29743 - DNA, 317 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatacgcaaactcaataaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29744 - DNA, 363 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctttctttctggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29745 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtacccccagcaggtggtgaccatcgccagaactcaagaaagcaatcccaccgcactgtttcaaacgctcgctccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29746 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 29747 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29748 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacctggcctctctactgggcctgccaagggtgcgtcctaaccggcgtctgggtcatagcccgcgagtgcggccaccactccttcagcgactac

SEQ ID NO: 29749 - DNA, 459 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcacgtctccagcggctgttgccggtgctgtgccaggcccacggcttgaccctcagcaggtggtggccatcgccagcaatggcggtggcaagcaggcgctggagacggtccagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29750 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccgtcagcgactac

SEQ ID NO: 29751 - DNA, 407 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtggacaccaaggcctactccggcggctacaacctgcccatcggccaggccgacgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctccgggtcatcgcccacgaatgcggccaccacgccttcagcgactac

SEQ ID NO: 29752 - DNA, 421 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgcaccggcaacagccgctggaccgtctccagcgcctgcttgccgccatcgtggctggcgatggccaccacctgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29753 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgaactcaagaaagcaatcccaccgcactgtttcaaacgctcgatccctcgctctctctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29754 - DNA, 425 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgctttccagtcgggaaacctgtcgtgccagctgcattaatgaatcggccaacgcgcggggagaggcggtttgcgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 29755 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaataaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 29756 - DNA, 411 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggtttttatgattagagtcccgcaattatacatttaatacgcgatagaaaacaaaatatagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29757 - DNA, 442 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgtccagcggctgttgccggtgctgtgccaggcccacggcttgaccccggagcaggtggtggccatcgccagccacgatggcggcaagcaggcgctggagagagacctcaagaaagcaatcccacctcactgcttcaaacgctcgatccctcgctctttctcctacctcagctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29758 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccgttcactgtttcaaacgctcgatccctcgctctttcttctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29759 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtcttaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29760 - DNA, 398 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtacttcaagtgtctcctccctccaaaaagtctgaaaccgacaacatacgcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29761 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgccgggcccctctactgggcctgccaaggctgcgtcctaacgggcctctgggtcatagcccacgagtgcggccaccacgccttcagcgactac

SEQ ID NO: 29762 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 29763 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccagggctgcgtcctaacgggcctctgggtcatcgcccacgaatgcggccaccacgccttcagcgactac

SEQ ID NO: 29764 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatcttggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29765 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgtgtcatagcccacgagtgcggccaccacgccttcagcgactac

SEQ ID NO: 29766 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaactggcgtctgggtcatagcccacgagtgcggccaccacgccttcagcgactac

SEQ ID NO: 29767 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29768 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatcgcccacgaatgcggccaccacgccttcagcgactac

SEQ ID NO: 29769 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29770 - DNA, 347 bp, Artificial
  Mutation in BnaA.FAD2.a introduced by TALE nuclease pair BnFAD2_T03
caggatccatgggtgcaggtggaagaatgtaagtgtctcctccatccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29771 - DNA, 405 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcaacagccgctggaccgtctccagcgcctgcttgccaccattattgctggcgagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29772 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcccggcctctctactgggcctgccagggctgcgtcctaaccggcgactgggtcatagcccacgagtgcggccaccacgcctgcagcgactac

SEQ ID NO: 29773 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggactgcgtcctaaccggcgtctgggtcatagcccacgagtgcggccaccacgccttcagcgactac

SEQ ID NO: 29774 - DNA, 319 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29775 - DNA, 351 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctcccgcaccctctctcctacttcgcctggcctctctactgggcctgccagggctgcgtcctaaccggcgtctgggtcatagcccacgagtgcggccaccacgccttcagcgactac

SEQ ID NO: 29776 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcgtcctaaccggcgtctgggtcatagcccacgagtgcggccaccacgccttcagcgactac

SEQ ID NO: 29777 - DNA, 351 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccaccattcactctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29778 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29779 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccctcagcgactac

SEQ ID NO: 29780 - DNA, 331 bp, Artificial
  Mutation in BnaA.FAD2.a introduced by TALE nuclease pair BnFAD2_T03
caggatccatgggtgcaggtggaagaatgcaagtctctcctccccccagctcccccgaaaccaaaaccctcaaacgcgtcccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29781 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctcttcgacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 29782 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29783 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29784 - DNA, 371 bp, Artificial
  Mutation in BnaA.FAD2.a introduced by TALE nuclease pair BnFAD2_T03
caggatccatgggtgcaggtggaagaatgcaagtgtctcctccctccaagaagtccgaaaccgacaccatcaagcgcgtaccctgcgagacaccgcccttcactgtcggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29785 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 29786 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgttaactcaagaaagcaatcccaccgcactgtttcaaacgctcgatccctcgctctttctcctacctcatctgggacttcatcatagcctcctgcttctactacgtcgccaccacttacttccctctcctccctcaccctctctcctacttcgcctggcctctctacggggcctgccagggctgcgtcctaacgggcctctgggtcatcgcccacgaatgcggccaccacgccttcagcgactac

SEQ ID NO: 29787 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaacgggcctctgggtcatagcccacgagtgcggccaccacgcgttcagcgactac

SEQ ID NO: 29788 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 29789 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29790 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcttacttcgcctggcctctctactgggcctgccagggctgcgtcctaaccggcgtctgggtcatagcccacgagtgcggccaccacgccttcagcgactac

SEQ ID NO: 29791 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcataatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29792 - DNA, 317 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccgtcagcgactac

SEQ ID NO: 29793 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 29794 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 29795 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 29796 - DNA, 401 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaggtggtggccatcgccagcaatggcggtggcaagcaggcgctggaccgttccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29797 - DNA, 345 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29798 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29799 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29800 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccgccacttacttccctctcctccctcaccctctctcctacttcgcctggtctctctactgggcctgccaagggtgcgtcctaacgggcctctgggtcatcgcccacgaatgcggccaccacgccttcagcgactac

SEQ ID NO: 29801 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29802 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29803 - DNA, 351 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29804 - DNA, 327 bp, Artificial
  Mutation in BnaA.FAD2.a introduced by TALE nuclease pair BnFAD2_T03
gcaggatccatgggtgcaggtggaagaatgcaagtgtctcctcactccaagaagtctgaaaccgacaccatcaagcgcgtaccctgcgagacaccgcccttcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29805 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcccgcttctactacgtcgccaccacttacttccctctcctccctcaccctctctcctacttcgcctggcctctatactgggcctgccagggctgcgtcctaaccggcgtctgggtcatagcccacgagtgcggccaccacgccttcagcgactac

SEQ ID NO: 29806 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29807 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29808 - DNA, 345 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29809 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 29810 - DNA, 350 bp, Artificial
  Mutation in BnaA.FAD2.a introduced by TALE nuclease pair BnFAD2_T03
caggatccatgggtgcaggtggaagaatgcaagtgtctcctccctcaaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtccgaaccggcgtctgggtcatagcccgcgagtgcggccacgacgcctgcagcgactac

SEQ ID NO: 29811 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 29812 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 29813 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccattcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcttctgggtcatagcccacgagtgcggccaccacgccttcagcgactac

SEQ ID NO: 29814 - DNA, 308 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcccgccagggctgcgtcctaaccggcgtctgggtcatcgcccacgaatgcggccaccacgccttcagcgactac

SEQ ID NO: 29815 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29816 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtcccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29817 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29818 - DNA, 403 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgaaccttcggtttgatcttctcctgttgctcggctatgtgccaggccatgctagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29819 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29820 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgacac

SEQ ID NO: 29821 - DNA, 348 bp, Artificial
  Mutation in BnaA.FAD2.a introduced by TALE nuclease pair BnFAD2_T03
caggatccgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29822 - DNA, 409 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccccctggcttgaccccggagcaggtggtggccatcgccagccacgatggcggcaacagccgctggaccgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29823 - DNA, 345 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacccctcaagaaagcaatcccacctcactgcttcaaacgctccatccctcgctctttctcctacctcatctgggacatcatcatagcctcctgcttctactacgtcgccaccacttacttccctctcctccctcaccctctctcctacctcgcctggcctctctactgggcctgccagggctgcgtcctaaccggcgtctgggtcatagcccacgagtgcggccaccacgccttcagcgactac

SEQ ID NO: 29824 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctcctggcctctctactgggcctgccaaggctgcgtcctaacgggcctctgggtcatcgcccacgaatgcggccaccacgccttcagcgactac

SEQ ID NO: 29825 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29826 - DNA, 351 bp, Artificial
  Mutation in BnaA.FAD2.a introduced by TALE nuclease pair BnFAD2_T03
caggatccatgggtgcaggtggtagaatgcaagtgtctcctccctccaagaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29827 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcctacgagtgcggccaccacgccttcagcgactac

SEQ ID NO: 29828 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtgaacgctctcctgagtataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatggctgcgtcctaaccggcgtctgggtcatagcccacgagtgcggccaccacgccttcagcgactac

SEQ ID NO: 29829 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaacctacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29830 - DNA, 401 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacggtccagcggctgttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 29831 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29832 - DNA, 354 bp, Artificial
  Mutation in BnaA.FAD2.a introduced by TALE nuclease pair BnFAD2_T03
caggatccatgggtgcaggtgggagaatgcaagtgtctcctccctccaaaaagtctgaaaccgacaacatcaagcgcgtaccctgcgagacaccgcccttcactgtcgggataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29833 - DNA, 443 bp, Artificial
  Mutation in BnaA.FAD2.a introduced by TALE nuclease pair BnFAD2_T03
caggatccatgggtgtaggtggaagaatgcaagtgtctcctccctccaaaaagtctgaaaccgacaacatcaagcgcgtaccctgcgagacaccgcccttcactgtcggtcataatgtttttggtacaaccgatttagctttatgctctgaggcttagaccgagatagggttgagtgttgttccagtttggaacaagagtccactatttaaagcaatcccaccgcactgtttcaaacgctcgatccctcgctctttctcctacctcatctgggacatcagcatagcctcctgcttctactacgtcgccaccacttacttccctctcctccctcaccctctctcctacttcgcctggcctctctactgggccagccagggctgcgtcctaacgggcctctgggtcatcgcccacgaatgcggccaccactccttcagcgactac

SEQ ID NO: 29834 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctaccctccctcaccctctctcctacttcgcctggcctctctactgggcctgccagggctgcgtcctaaccggcgtctgggtcatagcccacgagtgcggccaccacgccttcagcgactac

SEQ ID NO: 29835 - DNA, 397 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttggcggcaacagccgctggaccgtctccagcgcctgcttgccgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29836 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaggtacctcgcgaatgcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccccttacttccctctcctcccccaccctctcccttacctcgcctggcccctctactgggcctgccaaggctgcgtcctaacgggcctctgggtcatctcccacgaatgcggccaccacgccttcagcgactac

SEQ ID NO: 29837 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccgcttacttccctctcctccctcaccctctctcctacttcgcctggcctctctactgggcctgccagggctgcgtcctaaccggcgtctgggtcatagcccacgagtgcggccaccacgccgtcagcgactac

SEQ ID NO: 29838 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 29839 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29840 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggctaccacgccttcagcgactac

SEQ ID NO: 29841 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 29842 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaactcaataaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29843 - DNA, 343 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccatgacagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29844 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgtttcaaacgctcgatccctcgctctttctcctacctcatctgggacctcatcatctcctcctgcttctactacgtcgcccccacttacttacctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29845 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgaccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcaaagcccacgagtgcggccaccacgccttcagcgactac

SEQ ID NO: 29846 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 29847 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacttagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29848 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcagaactcaagaaagcaatcccacctcactgcttcaaacgctccgtccctcgctccttctcctacctcctcttcgacatcctcgtctcctcctccctctaccacctctccacagcctacttccctctcctccctcaccctctctcctacttcgcctggcctctctactgggcctgccaaggctgcgtcctcacgggcctctgggtcatagcccacgagtgcggccaccacgccttcagcgactac

SEQ ID NO: 29849 - DNA, 373 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctctaccacctctccacagcctacttccctctcccttacctcgcctgacccctctactgggcctgccaaggctgcgtcctaacgggcctctgggtaatagcccacgagtgcggccaccacgccttcagcgactac

SEQ ID NO: 29850 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgaatgcggccaccacgccttcagcgactac

SEQ ID NO: 29851 - DNA, 421 bp, Artificial
  Mutation in BnaA.FAD2.a introduced by TALE nuclease pair BnFAD2_T03
caggatccatgggtgcaggtggaagaatgcaagtgtctcctccctccaagaagtctgaaacctacaccatcaagcgcgtaccctgcgagacaccgcccttcactgaccgtctccagcgcctgcttgccggtgctgtgccgccatcgtggctggcgatggccaccacctgctccggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29852 - DNA, 409 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgccccctggcttgaccccggagcaggtggtggccatcgccagccacgatggcggcaccagccgctggaccgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgtgtcatagcccacgagtgcggccaccacgccttcagcgactac

SEQ ID NO: 29853 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttactcccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 29854 - DNA, 349 bp, Artificial
  Mutation in BnaA.FAD2.a introduced by TALE nuclease pair BnFAD2_T03
caggatccatgggtgcaggttgaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29855 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctagatccctcgctctttctcctacctcatctgggacatcatcatagcctcctgcttctactacgtcgccaccacttacttccatctcctccctcaccctctctcctacttcgcctggcctctctactgggcctgccagggctgcgtcctaaccggcgtctgggtcatagcccacgagtgcggccaccacgccttcagcgactac

SEQ ID NO: 29856 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcgggcctggcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29857 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttcttccaccgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactcc

SEQ ID NO: 29858 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 29859 - DNA, 408 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggacttcgctgctacccaaggttgccgggtgacgcacaccgtggaaacggatgaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29860 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcaccatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29861 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccgaaacaaaaaccctcaaacgcgtcccctgcgagacaccacccttcactctccccaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcgtccaccacgccttcagcgactac

SEQ ID NO: 29862 - DNA, 340 bp, Artificial
  Mutation in BnaA.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccgacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccgcgagtgcggccaccacgccttcagcgactac

SEQ ID NO: 29863 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcttagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29864 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaactggcgtctgggtcatagcccacgagtgcggccaccacgccatcagcgactac

SEQ ID NO: 29865 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29866 - DNA, 359 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcgccagaactcaagaaagcaatcccaccgcactgtttcaaacgctcgatccctcgttctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29867 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 29868 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccagggctgcgtcctaaccggcgtctgggtcatagcccacgaatgcggccaccacgccttcagcgactac

SEQ ID NO: 29869 - DNA, 350 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtcccctgcgagacaccaccattcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29870 - DNA, 353 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccagggctgcgtcctaaccggcgtctgggtcatagcccacgagtgcggccaccacgccttcagcactac

SEQ ID NO: 29871 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggatcatagcccacgagtgcggccaccacgccttcagcgactac

SEQ ID NO: 29872 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 29873 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 29874 - DNA, 345 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccactccagcagcgactgc

SEQ ID NO: 29875 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 29876 - DNA, 295 bp, Artificial
  Mutation in BnaA.FAD2.a introduced by TALE nuclease pair BnFAD2_T03
caggatccatgggtgcaggtggaagaattcaagtggctcctccctccaaaaagtctgaaaccgacaacatcaagcgcgtaccctgccagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 29877 - DNA, 371 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcgggtgtgggggttacgtagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29878 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggccatagcccacgagtgcggccaccacgccttcagcgactac

SEQ ID NO: 29879 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaatccgacaacatcaagcgcgtaccctgcgagacaccgcccttcactactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29880 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29881 - DNA, 422 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtaccctgcgagacaccgcccttcactgtcggcaagcaggcgctggagacggtccagcggctgttgccggtgctgtgccaggcccacggcttgaccacggcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29882 - DNA, 337 bp, Artificial
  Mutation in BnaA.FAD2.a introduced by TALE nuclease pair BnFAD2_T03
caggatccatgggtgcaggtggaagaatgcaagtgcctcctccctccaaaaagtctgaaaccgacaacatcaagcgcgtaccctgcgagacaccgcccttcactgtgagaactcaagaaagcaatcccaccgcactgtttcaaacgctcgatccctcgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 29883 - DNA, 392 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtaatctggaacatcgtatgggtaatcgatgaccttacgtttaaactcaagaaagcaatcccaccgcactgtttcaaacgctcgatccctcgctctttctcctacctcatctgggacatcgtcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29884 - DNA, 277 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 29885 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggccgcgtcctaacgggcctctgggtcatcgcccacgaatgcggccaccacgccttcagcgactac

SEQ ID NO: 29886 - DNA, 333 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccgaactcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 29887 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagtagcctgaaaccgacaccctcaagcgcgtaccctgcgagacaccgcccttcactgagaactcaagaaagcaatcccaccgcactgtttcaaacacacggtccctcgctctctctcctacctcatctgggacatcatcatatcctcctgcttctactccgtcgccacctcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29888 - DNA, 370 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaatggcaagcaggcgccggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29889 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccaccattcactctcgacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 29890 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgagtgcggccaccacgccttcagcgactac

SEQ ID NO: 29891 - DNA, 325 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtctggcctctctactgggcctgccagggctgcgtcctaaccggcgtctgggtcatagcccacgagtgcggccaccacgccttcagcgactac

SEQ ID NO: 29892 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctgacccctctactgggcctgccaaggctgcgtcctaacgggcctctgggtcatagcccacgagtgcggccaccacgccatcagcgactac

SEQ ID NO: 29893 - DNA, 342 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29894 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29895 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29896 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacactcaagaaagcaatcccaccgcactgtttcaaacgctcgatccctcgctctttctcctacctcatctggggcatcatcatagcctcctgcttctactacgtcgccaccacttacttccctctcctcccccaccctctcccttacctcgcctggcccctctactgggcctgccaaggctgcgtcctaacgggcctctgggtcatcgcccgcgaatgcggccaccacgccttcagcgactac

SEQ ID NO: 29897 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29898 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccagggctgcgtcctaaccggcgtctgggtcatagcccacgagtgcggccaccacgccttcagcgactac

SEQ ID NO: 29899 - DNA, 329 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29900 - DNA, 348 bp, Artificial
  Mutation in BnaA.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29901 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccagggctgcgtcctaaccggcgtctgggtcatagcccacgagtgcggccaccacgccttcagcgactac

SEQ ID NO: 29902 - DNA, 293 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcccttacctcgcctgacccctctactgggcctgccaaggctgcgtcctaacgggcctccgggtcatagcccacgagtgcggccaccacgccttcagcgactac

SEQ ID NO: 29903 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 29904 - DNA, 332 bp, Artificial
  Mutation in BnaA.FAD2.a introduced by TALE nuclease pair BnFAD2_T03
caggatccatgggtgcaggtggaagaattcaagtgtctcctccctccaaaaagtctgacaccgacaacatcaagcgcgtaccctgcgagacaccgcccttcactgtcccacctcactgtttcaaacgctcgctccctcgctctttctcctacctcatctggtacatcatcatagcctcctgcttctactacgtcgccaccacttacttccctctcctccctcaccctctctcctacttcgcctggcctctctactgggcctgccaagggtgcgtcctaaccggcgtcttggtcatagcccacgagtgcggccaccacgccttcagcgactac

SEQ ID NO: 29905 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaactggcgtctgggtcatagcccacgagtgcggccaccacgccttcagcgactac

SEQ ID NO: 29906 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccatggctgcgtcctaacgggcctctgggtcatcgcccacgaatgcggccaccacgccatcagcgactac

SEQ ID NO: 29907 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 29908 - DNA, 389 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcttcaagtatgacgggctgatactgggccggcaggcgctccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29909 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtccgaacgggcctctgggtcatcgcccacgaatgcggccaccacgccatcagcgactac

SEQ ID NO: 29910 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgtgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29911 - DNA, 468 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcccccccagcaggtggtggccatcgccagcaatggcggtggcaagcaggcgctggagacggtccttgaacgttgtgaagcaacggcccggagggtggcgggcaggacgcccgccataaactaccaggcatcaagaaagcaatcccaccgccctgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29912 - DNA, 348 bp, Artificial
  Mutation in BnaA.FAD2.a introduced by TALE nuclease pair BnFAD2_T03
caggatccatgggtgcaggtggtagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29913 - DNA, 351 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 29914 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 29915 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttcccctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29916 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccaccgcactgtttcaaacgctcgatcactcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29917 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccccctcctccctcaccctctcccttacctcgcctggcccctctactgggcctgccaaggctgcgtcctaacgggcctctgggtcatcgcccacgaatgcggccaccacgccttcagcgactac

SEQ ID NO: 29918 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctacagggcctgccagggctgcgtcctaaccggcgtctgggtcatagcccacgagtgcggccaccacgccttcagcgactac

SEQ ID NO: 29919 - DNA, 349 bp, Artificial
  Mutation in BnaA.FAD2.a introduced by TALE nuclease pair BnFAD2_T03
aggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29920 - DNA, 468 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggattgcaaaacgtggcggcgtgaccgcagtggaggcagtgcatgcatggcgcaatgcactgacgggtgccccgctcaacttgaccccccagcaggtggtggccatcgccagcacggagaactcaagaaagcaatcccaccgcactgtttcaaacgctcgatccctcgctctttctcctacctcagctgggacatcatcatagcctcctgcttctactacgtcgccaccacttactttcctctcctccctcaccctctctcctacttcgcctggcctctctactgggcctgccagggctgcgtcctaaccggcgtctgggtcatagcccacgagtgcggccaccacgccttcagcgactac

SEQ ID NO: 29921 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29922 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatctcaccgcactgtttcaaacgctcgctccctcgctctttctcctacctcatctgggccatcatcatatcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29923 - DNA, 389 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggtttgtttgccggatcaagagctaccaactctttttccgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 29924 - DNA, 350 bp, Artificial
  Mutation in BnaA.FAD2.a introduced by TALE nuclease pair BnFAD2_T03
caggatccatgtgtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29925 - DNA, 370 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtgaacgctctcctgagtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 29926 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29927 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29928 - DNA, 374 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttttgccagcgcctaatgcgccgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29929 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcacgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29930 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccactccctcagcgactac

SEQ ID NO: 29931 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29932 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgctagggctgcgtcctaaccggcgtctgggtcatagcccacgagtgcggccaccacgccttcagcgactac

SEQ ID NO: 29933 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtaatcgcccacgaatgcggccaccacgccttcagcgactac

SEQ ID NO: 29934 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29935 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccgtcagcgactac

SEQ ID NO: 29936 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtcggaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactgcgtcgccaccacttacttccctctcctccctcaccctctctcctacttcgcctggcctctctactgggcctgccagggctgcgtcctaaccggcgtctgggtcatagcccacgagtgcggccaccacgccttcagcgaccac

SEQ ID NO: 29937 - DNA, 413 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggatgggatccgatccaatgaagacaatcgacatagtgactggatatgttgtgttttacagagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29938 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttgcctctcctccctcaccctctctcctacttcgcctggcgtctctactgggcctgccaagggggcgtcctaaccggagtctgggtcatagcccacgagtgcggccaccacgccatcagcgactac

SEQ ID NO: 29939 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaatcaagaaagcaatcccaccgcactgtttctaacactcgctccctcgctctttctcctacctcatcaggtacatcatcataacctcctgcttctactacttcgccaccactcacttccctctcctccctcaccctctcgcctacctcgcctggcctctctactgggcctgccagggctgcgtccgaaccggcgtctgggtcatagcccacgagtgcggccaccacgccatcagcgactac

SEQ ID NO: 29940 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctcaccggcgtctgggtcatagcccacgagtgcggccaccacgccttcagcgactac

SEQ ID NO: 29941 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcgaccaccacgccttcagcgactac

SEQ ID NO: 29942 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacggacctctgggtcatcgcccacgaatgcggccaccacgccttcagcgactac

SEQ ID NO: 29943 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29944 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactgagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29945 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgccctagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29946 - DNA, 406 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtccgactgggcctttcgttttatctgttgtttgtcggtgaacgctctcctgagtaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 29947 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcataggccacgagtgcggccaccacgccttcagcgactac

SEQ ID NO: 29948 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29949 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatgatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 29950 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29951 - DNA, 371 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcgggtgtggtggttacgtagacctcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29952 - DNA, 468 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggattgcaaaacgtggcggcgtgaccgcagtggaggcagtgcatgcatggcgcaatgcactgacgggtgccccgctcaacttgaccccccagcaggtggtggccatcgccagcacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29953 - DNA, 450 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgagcgatcgttggcgtcggcaaacagtggtccggcgcacgcgctctggaggccttgctcacggtggcgggagagttgagaggtccaccgttacagttggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29954 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccccctcctccctcaccctctctcctacttcgcctggcctctctactgggcctgccagggctgcgtcctaaccggcgtctgggtcatagcccacgagtgcggccaccacgccttcagcgactac

SEQ ID NO: 29955 - DNA, 360 bp, Artificial
  Mutation in BnaA.FAD2.a introduced by TALE nuclease pair BnFAD2_T03
caggatccatgggtgcaggtggaagaatgcaagtgtcacctccctccaaaaagtctgaaaccgacaacatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29956 - DNA, 354 bp, Artificial
  Mutation in BnaA.FAD2.a introduced by TALE nuclease pair BnFAD2_T03
caggatccatgggtgcaggtggaagaatgtaagtgtctcctccctccaagaagtctgaaaccgacaccatcaagcgcgtaccctgcgagacaccgcccttcactgattgtagaactcaagaaagcaatcccaccgcactgtttcaaacgctcgatccctcgctctctctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29957 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29958 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctatcctccctcaccctctctcctacttcgcctggcctctctactgggcctgccagggctgcgtcctaaccggcgtctgggtcatagcccacgagtgcggccaccacgccttcagcgactac

SEQ ID NO: 29959 - DNA, 349 bp, Artificial
  Mutation in BnaA.FAD2.a introduced by TALE nuclease pair BnFAD2_T03
caggatccatgggtgcagctggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29960 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccaacaacatcaagcgcgtaccctgcgagacaccgcccttcactgagaactcaagaaagcaatcccaccgcactgtttcaaacgctcgatacctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29961 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccattcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctggcctctctactgggcctgccaagggtgcgtcctaaccggcgtctgggtcatagcccacgagtgcggccaccacgccttcagcgactac

SEQ ID NO: 29962 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaaacgcgtaccctgcgagacaccgcccttcactgtgagaactcaagaaagcaatcccaccgctctgtttcaaacgctctatccctcgctctttctcctacctcatctgttacatcatcatagcctcctgcttctactacatcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 29963 - DNA, 385 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcacgaggcttgttgtgaagggattccaacaaaaagtaggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29964 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 29965 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtcccctgcgagacaccgcccttcactggagaactcaagaaagcaatcccaccgcactgtttcaaacgctcgctccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29966 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagcgtgcgtcctaacgggcctctgggtcatagcccgcgtgtgcggccaccacgccttcagcgactac

SEQ ID NO: 29967 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29968 - DNA, 343 bp, Artificial
  Mutation in BnaA.FAD2.a introduced by TALE nuclease pair BnFAD2_T03
caggatccatgggtgcaggtggaagaatgcaagtgtctcttccttctaaaaagtctgaaaccgacaacatcaagcgcgtaccctgcgagacaccgcccttcactgttagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29969 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcatacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29970 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 29971 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcggcctaaccggcgtctgggtcatagcccacgagtgcggccaccacgccttcagcgactac

SEQ ID NO: 29972 - DNA, 456 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgataacatcaagcgcgtaccctgcgagacaccgcccttcactgtcggcggctgttgccggtgctgtgccaggcccacggcttgaccccggagcaggtggtggccatcgccagcaatattggtggcaagcaggcgctggagacggtgcaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 29973 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacctgcgtctgggtcatagcccacgagtgcggccaccacgccttcagcgactac

SEQ ID NO: 29974 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcggcctaaccggcgtctgggtcatagcccacgagtgcggccaccacgcctgcagcgactac

SEQ ID NO: 29975 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcacaccgcactgtttcaaacgctcgatccctcgctctttctcctacctcatctgggacatcatcatagcctcctgcttctactacgtcgcaaccacttacttccctctcctccctcaccctctctcctacttcgcctggcctctctactgggcctgccagggctgcgtcctaaccggcgtctgggtcatatcccacgagtgcggccaccacgccttcagcgactgc

SEQ ID NO: 29976 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29977 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29978 - DNA, 336 bp, Artificial
  Mutation in BnaA.FAD2.a introduced by TALE nuclease pair BnFAD2_T03
caggatccatgggtgcaggtgcaagaatgcaagtgtctcctccatccaaaaagtctgaaaccgacaacatcaagcgcgtaccctgcgagacaccgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29979 - DNA, 438 bp, Artificial
  Mutation in BnaA.FAD2.a introduced by TALE nuclease pair BnFAD2_T03
caggatccatgggtgcaggtggaagaatgcaagtttctcctccctcaaagaagtctgaaaccgacaccatcaagcgcgtaccctgcgcgacaccgcccttcactgttcgttggtcaacgcggccaacgccggatcagggcgagataactgggcaacaatgctctccagcgcctgttgccggtgctgtgccaggccgaactcaagaaagcaatcccaccgcactgtttcaaacgctcgatccctcgctctttcgcctaccacagctgggacagcaacatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29980 - DNA, 404 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgtctccagcgcctgcttgccgccatcgtggctggcgatggccaccacctgctccggactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29981 - DNA, 350 bp, Artificial
  Mutation in BnaA.FAD2.a introduced by TALE nuclease pair BnFAD2_T03
caggatccatgggtgcaggtgaaagaatgcaagtctctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 29982 - DNA, 384 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagactgagcctttcgttttatctgttgtttgtcggtgaacgctctcctgagtaggtaaaatccgctctgtttcaaacgctcgatccctcgctctttctcctacctcatctgggacatcatcatagcctcctgcttctactacgtcgccaccacttccttccctctccccccccaccctctcccttccctcgcctggcccctctactgggcccgccaaggctgcgtcctaacgggcctctgggtcatcgcccacgaatgcggccaccacgccttcagcgactac

SEQ ID NO: 29983 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctccctcaacctctctcctacttcgcctggcctctctactgggcctgccaagggtgcgtcctaaccggcgtctgggtcatagcccacgagtgcggccaccacgccttcagcgactac

SEQ ID NO: 29984 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 29985 - DNA, 327 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcatcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 29986 - DNA, 350 bp, Artificial
  Mutation in BnaA.FAD2.a introduced by TALE nuclease pair BnFAD2_T03
caggatcatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 29987 - DNA, 283 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 29988 - DNA, 345 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccggcaacatcaagcgcgtaccatgcgagacaccgccctttagaactcaagaaagcaatcccaccgcactgtttcaaacgctcgatccctcgctctttctcctacctcatctgggacatcatcatagcctcctgcctctactacgtcgccaccacttacttgcctatcctccctcaccctctctcctacttcgcctggcctctctactgggcctgccagggctgcggcctaaccggcgtctgggtcatagcccacgagtgcggccaccacgccttcagcgactac

SEQ ID NO: 29989 - DNA, 349 bp, Artificial
  Mutation in BnaA.FAD2.a introduced by TALE nuclease pair BnFAD2_T03
caggatccatggggcaggtggcagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29990 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacctcatcatagcctcctgcttctactacgtcgccaccacttacttccctctcctccctcaccctctctcctacctcgcctggcctctctactgggcctgcaagggctgcgtcctaacgggcgtctgggtcatagcccacgagtgcggccaccacgccttcagcgactac

SEQ ID NO: 29991 - DNA, 383 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgaggcccacggcttgacccccgagcaggtcgtggccatcgcctcgcacgattgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29992 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgtaaccaacaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29993 - DNA, 303 bp, Artificial
  Mutation in BnaA.FAD2.a introduced by TALE nuclease pair BnFAD2_T03
caggatccatggtgcatgtggaagaatgcaagtgtctcctccctccaaaaagtctgaaaccgacaacatcaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcccctctactgggcctgccaaggctgcgtcctaacgggcctctgggtcatcgcccacgaatgcggccaccacgccttcagcgactac

SEQ ID NO: 29994 - DNA, 408 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaacagccgctggaccgtctccaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 29995 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccaacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 29996 - DNA, 347 bp, Artificial
  Mutation in BnaA.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactgaactcaagaaagcaatcccaccgcactgtttcaaacgctcgatccctcgctctttctcctaactcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29997 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaacctacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 29998 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 29999 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttaaaacgctcgatcactcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcccttcagcgactac

SEQ ID NO: 30000 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagaaagcaatcccaccgcactgtttcaaacgctcgatacctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30001 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgcctggcctctctactgggcctgccaaggctgcgtcctaaccggcgtctgggtcatggcccacgagtgcggccaccacgccatcagcgactac

SEQ ID NO: 30002 - DNA, 334 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttactcaagaaagcaatcccaccacactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30003 - DNA, 350 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctaccaagggtgcgtcctaaccggcgtctgggtcatagcccacgagtgcggcctccacgccttcagcgactac

SEQ ID NO: 30004 - DNA, 347 bp, Artificial
  Mutation in BnaA.FAD2.a introduced by TALE nuclease pair BnFAD2_T03
caggatccatgggtgcaggtggaagaatgtaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 30005 - DNA, 280 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 30006 - DNA, 329 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 30007 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgcttcaaacgctcgatccctcgctctttctcctacctaatctgggacatcatcatagcctcctgcttctactacgtcgccaccacttacttccctctcctccctcaccctctctcctacgtcgcctggcctctctactgggcctgccaagggtgcgtcctaaccggcgtctgggtcatagcccacgagggcggccaccacgccttcagcgactac

SEQ ID NO: 30008 - DNA, 463 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggtggcaagcaggcgctggagacggtccagcggctgtttgccaccaatattgctggcgatggccaccacctgctccggggtcaagccgtgggcctggcacagcaccggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctaccgggcctgccaggactgcgtcctaaccggcgtctgggtcatagcccacgagtgcggccaccacgccttcagcgactac

SEQ ID NO: 30009 - DNA, 448 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccccagcaggtggtgaccatcgccagcaataatggtggcaagccagcggctgttgccggtgctgtgccaggcccacggcttgaccccccagcaggtggtggccatcgccagcaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacttggcctgccagggctgcgtcctaacgggcctctgggtcatcgcccacgaatgcggccaccacgccttcagcgactac

SEQ ID NO: 30010 - DNA, 307 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactttttcaaacgctcgatccctcgctctttctcctcttcgacatcatcatctcctcctcggctcctccctctaccacctctcctacttcgcctggcctctctactgggcctgccagggctgcgtcctaaccggcgtctgggtcatagcccacgagtgcggccaccacgccttcagcgactac

SEQ ID NO: 30011 - DNA, 414 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgccctaaaaaagcattgctcatcaatttgttgcaacgaacaggtcactatcagtcaaaataaaatcattatttgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30012 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgtttcaaacgctcgatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 30013 - DNA, 348 bp, Artificial
  Mutation in BnaA.FAD2.a introduced by TALE nuclease pair BnFAD2_T03
caggatccatgggtgcaggtggaagaatgcaagtgtctccttcctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30014 - DNA, 452 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaatggcggtggcaagcaggcgctggagacggtccagcggctgttgccggtgctgtgccaggcccacggcttgaccccggagcaggtggtggccaccgccatggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30015 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30016 - DNA, 370 bp, Artificial
  Mutation in BnaA.FAD2.a introduced by TALE nuclease pair BnFAD2_T03
caggatacatgggtgcaggtggaagaatgcaagtgtctcctccctccaagaagtctgaaaccgacaacatcaagcgcgtaccctgcgagacaccgcccttcactgtcggtgaacgctctcctgagtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30017 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgccattcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30018 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccgcactgtttcaaacgctcgaaccctcgctccttctcctacctcatctgcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30019 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcgcacgagtgcggccaccacgccttcagcgactac

SEQ ID NO: 30020 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctcttctacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30021 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctgacccctctactgggcctgccaaggctgcgtcctaacgggcctctgggtcatagcccacgagtgcggccaccacgccttcagcgactac

SEQ ID NO: 30022 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctacttcgcctggcctctctactgggcctgccagggctgcgtcctaaccggcgtctgggtcatagcccacgagtgcggccaccacgccttcagcgactac

SEQ ID NO: 30023 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgtgtcctaaccggcgtctgggtcatagcccacgagtgcggccaccacgccttcagcgactac

SEQ ID NO: 30024 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaaaatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacctgcgtctgggtcatagcccacgagtgcggccaccacgccttcagcgactac

SEQ ID NO: 30025 - DNA, 341 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacaccgcccttcactgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30026 - DNA, 403 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcggctgttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30027 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccactagtgcggccaccacgccttcagcgactac

SEQ ID NO: 30028 - DNA, 347 bp, Artificial
  Mutation in BnaA.FAD2.a introduced by TALE nuclease pair BnFAD2_T03
caggatccatgggtgcaggtggaagaatgcaagtgtctcctccctccaacaagtctgaaaccgacaacatcaagcgcgtaccctgcgagacaccacccttcactgaactcaagaaagcaatcccaccgcactgtttcaaacgctcgatccctcgctctttctcctacctcatctgcgacatcatcatcgcctcctgcttctactacgtcgccaccacctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30029 - DNA, 347 bp, Artificial
  Mutation in BnaA.FAD2.a introduced by TALE nuclease pair BnFAD2_T03
caggatccatgggtgcaggtgcaagaatgcaagtgtctcctccctccaagaagtctgaaaccgacaccatcaagcgcgtaccctgcgagacaccgcccttcacttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30030 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaaacgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30031 - DNA, 454 bp, Artificial
  Mutation in BnaA.FAD2.a introduced by TALE nuclease pair BnFAD2_T03
caggatccatgggtgcaggtgcaagaatgcaagtgtctcctccctccaaaaagtctgaaaccgacaacatcaagcgcgtaccctgcgagacaccgcccttcactgaccgtctccagcgcctgcttgccaccattattgctggcgatggcccccacctgctccggggtcaagccgtgggcctggcacagcaccggcaacaggcgctggagaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcggccaccacgccttcagcgactac

SEQ ID NO: 30032 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30033 - DNA, 455 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaacagccgctggaccgtctccagcgcctgcttgccgccatcgtggctggcgatggccaccacctgctccggagaactcaagaaagcaatcccaccgcactgtttcaaacgctcgatccctcgctctttctcctacctcagctgggacagcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30034 - DNA, 351 bp, Artificial
  Mutation in BnaA.FAD2.a introduced by TALE nuclease pair BnFAD2_T03
caggatccatgggtgcaggtggaagaatgcaagtatctactccctccaaaaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30035 - DNA, 407 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgtggacaccaaggcctactccggcggctacaacctgcccatcggccaggccgacgaagaactcaagaaagcaatcccaccgcactgtttcaaacgctcgatccctcgctctttctcctacctcatctgggacatcgtcatagcctcctgcttctactacgtcgccaccacttacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 30036 - DNA, 356 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30037 - DNA, 394 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgccggtgctgtgccaggcccacggcttgaccccccagcaggtggtgggaactcaagaaagcaatcccaccgcactgtttcaaacgctcgatccctcgctctttctcctacctcatctgggacatcatcatagcctcctgcttctactacatcgcccccacttacttccctctcctccctcaccctctctcctacttcgcctggcctctctactgggcctgccaaggctgcttcctaacgggcctctgggtcatcgcccacgaatgcggccaccacgccttcagcgactac

SEQ ID NO: 30038 - DNA, 309 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30039 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatgggtgcgtcctgacgggcctctgggtcatagcccacgagtgcggccaccacgccttcagcgactac

SEQ ID NO: 30040 - DNA, 340 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgatac

SEQ ID NO: 30041 - DNA, 348 bp, Artificial
  Mutation in BnaA.FAD2.a introduced by TALE nuclease pair BnFAD2_T03
caggatccatgggtgcaggcggaagaatgcaagtgtctcctccctccaagaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcttggtcatagcccacgagtgcggccaccacgccttcagcgactac

SEQ ID NO: 30042 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactttgaactcaagaaagcaatcccaccgcactgtttcaaacgctcgatccctcgctctttctcctacctcatctgggacatcatcatagcctcccgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30043 - DNA, 347 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactggtcctgccaaggctgcgtcctaacgggcctctgggtcatcgcccacgaatgcggccaccacgccttcagcgactac

SEQ ID NO: 30044 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggggcatagcccacgagtgcggccaccacgccttcagcgactac

SEQ ID NO: 30045 - DNA, 386 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgccagccacgatggcggcaacagccgctggaccggagaactcaagaaagcaatcccaccgcactgtttcaaacgctcgatccctcgctctttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30046 - DNA, 396 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagccaccgcccttcactgtcggttcctggccttttgctggccttttgctcacatgttctttccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaaccggcgtctgggtcatagcccacgagtgcggccaccacgccttcagcgactac

SEQ ID NO: 30047 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30048 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30049 - DNA, 422 bp, Artificial
  Mutation in BnaA.FAD2.a introduced by TALE nuclease pair BnFAD2_T03
caggatccatgggtgcaggtgcaagaatgcaagtgtcccctccatccaagaagtctgaaaccgacaccatcaagcgcgtaccctgcgagacaccgcccttcactgtcggcaagcaggcgctggagactgtccagcggctgttgccggtgctgggccaggcccacggcttgaccacggcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30050 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccgatctagaactcaagaaagcaatcccaccgcactgtttcaaacgctcgatccctcgctctttctcctacctcatctggggcatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30051 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctatcctccctcaccctctctcctacttcgcctggcctctctactgggcctgccagggctgcgtcctaaccggcgtctgggtcatagcccacgagtgcggccaccacgccttcagcgactac

SEQ ID NO: 30052 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30053 - DNA, 406 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgccgtcgggcttcctggagccgcccgatttagagcttgacggggaaagccggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30054 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaactggcgtctgggtcatagcccacgagtgcggccaccacgccttcagcgactac

SEQ ID NO: 30055 - DNA, 324 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgccctttcaagaaagcaatcccaccgcactgtttcaaacgctcgatccctcgctctttctcctacctcatctgggacatcatcatagcctcctgcttctaccacctctccacagcctacttccctctcccttacctcgcctgacccctctactgggcctgccaaggctgcgtcctaacgggcctctgggtcatcgcccacgagtgcggccaccacgccttcagcgactac

SEQ ID NO: 30056 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatatcccacgagtgcggccaccacgccttcagcgactac

SEQ ID NO: 30057 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctgcctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30058 - DNA, 421 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgcaccggcaacagccgctggaccgtctccagcgcctgcttgccgccatcgtggctggcgatggccaccacctgaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30059 - DNA, 350 bp, Artificial
  Mutation in BnaA.FAD2.a introduced by TALE nuclease pair BnFAD2_T03
caggatccatgggtgcaggtgggagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 30060 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccacctcactgcttcaaacgctcgatccctcgctctttctcctacctcatctgtgacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30061 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 30062 - DNA, 359 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggatcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 30063 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcagcctctctcctacttcgcctggcctctctactgggcctgccaagggtgcgtcctaaccggcgtctgtgtcatagcccacgagtgcggccaccacgccttcagcgactac

SEQ ID NO: 30064 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30065 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacctcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30066 - DNA, 308 bp, Artificial
  Mutation in BnaA.FAD2.a introduced by TALE nuclease pair BnFAD2_T03
caggatccatgggtgcaggcggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccatcagcgactac

SEQ ID NO: 30067 - DNA, 350 bp, Artificial
  Mutation in BnaA.FAD2.a introduced by TALE nuclease pair BnFAD2_T03
caggatccatgggtgcaggtggaagaatgcaagtgtctcatccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30068 - DNA, 308 bp, Artificial
  Mutation in BnaA.FAD2.a introduced by TALE nuclease pair BnFAD2_T03
caggatccatgggtgcaggtggaagaatgcaagtgtctcctccctcccagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcaacgactac

SEQ ID NO: 30069 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30070 - DNA, 339 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 30071 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagaactcaagaaagcaatccccccgcactgtttcacacgctcgatccctcgctctttctcctacctcatctgggacctcatcatagcctcctgctcctactacgtcgccaccacttacttccctctcctccctcacccgctctcctgcctcgcctggcctctctactgggcccgccaagggtgcgtcctaaccggcgtctgggtcatagcccacgagtgcggccaccacgccatcagcgactac

SEQ ID NO: 30072 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30073 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 30074 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccctcaagcgcgtacccttcgagaccccccccttcactgtactcaagaaagcaatcccaccgcactgtttcaaacgctcgatccctcgctctttctcctacctcatctgggacatcatcatcgcctcctgcttctactacttcgccaccacttacttccctctcctccctcaccctctctcctacctcgcctggcctctctactgggcctgccagggctgcgtcctaaccggcgtctgggtcatagcccacgagtgcggccaccacgccttcagcgactac

SEQ ID NO: 30075 - DNA, 349 bp, Artificial
  Mutation in BnaA.FAD2.a introduced by TALE nuclease pair BnFAD2_T03
caggatccatgggtacaggtggaagaatgcaagtgtctcctccctccaagaagtctgaaaccgacaccatcaagcgcgtaccctgcgagacaccgcccttcactgtatcatcaagaaagcaatcccaccgcactgtttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30076 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 30077 - DNA, 428 bp, Artificial
  Mutation in BnaA.FAD2.a introduced by TALE nuclease pair BnFAD2_T03
caggatccatgggtgcaggtggaagaatgcaagtctctcctccctcccaaaagtctgaaaccgacaacatcaagcgcgtaccctgcgagacaccgcccttcactgttgcgcgtaaccaccacacccgccagcgccctagcgcccgctcctttcgctttcttcccttcctttctcgccacgttcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30078 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 30079 - DNA, 403 bp, Artificial
  Mutation in BnaA.FAD2.a introduced by TALE nuclease pair BnFAD2_T03
caggatccatgggtgcaggtggaagcatgcaagtgtctcctccctccaaaaagtctgaaaccgacaacatcaagcgcgtaccctgcgagacaccgcccttcactgtcgaaccttcggtttgatcttctcctgttgctcggctatgtgccaggccatgctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30080 - DNA, 381 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttcgaggcatttctgtcctggctggcctagcggagaactcaagaaagcaatcccaccgcactgtttcaaacgctcgatccctcgctcgttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30081 - DNA, 412 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggctgttgccggtgctgtgccaggcccacggcttgaccccggagcaggtggtggccatcggatacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30082 - DNA, 385 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgaggcttgttgtgaagggattccaacaaaaagtaggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30083 - DNA, 350 bp, Artificial
  Mutation in BnaA.FAD2.a introduced by TALE nuclease pair BnFAD2_T03
caggatccatgggtgcaggtgaaagaatgcaagtgtctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcttggtcatagcccacgagtgcggccaccacgccttcagcgactac

SEQ ID NO: 30084 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 30085 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctcctcaccctctctcctacttcgcctggcctctctactgggcctgccagggctgcgtcctaaccggcgtctgggtcatagcccacgagtgcggccaccacgccttcagcgactac

SEQ ID NO: 30086 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 30087 - DNA, 308 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30088 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 30089 - DNA, 426 bp, Artificial
  Mutation in BnaA.FAD2.a introduced by TALE nuclease pair BnFAD2_T03
caggatccatgggtgcagctggaagaatgcaagtctctcctccctccagctcccccggaaccaacaccctcaaacgcgtcccctgcgagacaccaccattcactctcggcaacagccgctggaccgtctccagcgcctgcttgccaccattattgctggcgatggccaccacctgccatcccacgttccagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30090 - DNA, 334 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30091 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgcctgggctgcgtcctaaccggcgtctgggtcatagcccacgagtgcggccaccacgccttcagcgactac

SEQ ID NO: 30092 - DNA, 349 bp, Artificial
  Mutation in BnaA.FAD2.a introduced by TALE nuclease pair BnFAD2_T03
caggatccatgggtgcaggtggaataatgcaagtgtctcctccctccaaaaagtctgaaaccgacaacatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30093 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30094 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 30095 - DNA, 357 bp, Artificial
  Mutation in BnaA.FAD2.a introduced by TALE nuclease pair BnFAD2_T03
caggatccatgggtgcaggtggaagaatgcaagtggctcctccctccaagaagtctgaaaccgacaccatcaagcgcgtaccctgcgagacaccgcccttcactgtttttgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggtcaccacgccttcagcgactac

SEQ ID NO: 30096 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttcgcctacctcatctgggacatcatcatagcctcctgcttctaccacctctccacagcctacttccctctcctctcccacccgctcccttacctcgcctgacccctctactgggcctgccaagggtgcgtcctaaccggcgtctgggtcatagcccacgagtgcggccaccacgccttcagcgactac

SEQ ID NO: 30097 - DNA, 382 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggttcctgcccttttgctggccttttgctcacatgttctttccggagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30098 - DNA, 350 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcataggccacgagtgcggccaccacgccttcagcgactac

SEQ ID NO: 30099 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcataagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30100 - DNA, 383 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaacgaccttttggaaacttcggcttcccctgaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30101 - DNA, 345 bp, Artificial
  Mutation in BnaA.FAD2.a introduced by TALE nuclease pair BnFAD2_T03
caggatccatgggtgcaggtggaagaatgcaagtgtctccgccctccaagaagtctgaaaccgacaccatcaagcgcgtaccctgcgaggcaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30102 - DNA, 450 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgttgagcgatcgttggcgtcggcaaacagtggtccggcgcacgcgctctggaggccttgctcacggtggcgggagagttgagaggtccaccgttacagttggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 30103 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacctcaagcgcgtaccctgcgagacaccgcccttcactctcggaagaactcaagaaagcaatcccaccgcactgtttcaaacgctctatccctcgctctttctcctacctcatctgggacatcatcatagcctcctgcttctactacgtcgccaccgcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30104 - DNA, 382 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctcgagcgccatctcgaaccgacgttgctggccgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 30105 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaaccccccaaaccgcgtcccttgcgagccaccacaattcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30106 - DNA, 350 bp, Artificial
  Mutation in BnaA.FAD2.a introduced by TALE nuclease pair BnFAD2_T03
caggatccatgggtgcagggggaagaatgcaagtgtctcatccatccaaaaagtctgaaaccgacaacatcaagagcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30107 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaagtctgaaaccgacaacatcaagcgcgtaccctgcgagacaccgcccttcactgtagaactcaagaaagtaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30108 - DNA, 344 bp, Artificial
  Mutation in BnaA.FAD2.a introduced by TALE nuclease pair BnFAD2_T03
caggatccatgggtgcaggtggaagaatgcaagtatctcctccctccaaaaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcgcgactac

SEQ ID NO: 30109 - DNA, 463 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaactgccaggcatcaaactaagcagaaggccatccggcaatggcggtggccaccacctgctggggggtcaagccgtgggcctggcacagcaccggccaccgccgctggaccggagacctcaagaaagcaatcccaccgcactgtttcaaacgctcgatccctcgctcttgctccgacctcagctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30110 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccagggctgcgtcctaaccggcgtctgggtcatagcccacgagtgcggccaccacgccttcagcgactac

SEQ ID NO: 30111 - DNA, 348 bp, Artificial
  Mutation in BnaA.FAD2.a introduced by TALE nuclease pair BnFAD2_T03
caggctccatgggtgcaggtggaagaatgcaagtgcctcctccctccaaaaagtctgaaaccgacaacatcaagcgcgtaccctgcgagacaccgcccttcaccgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 30112 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtccgaaccggcgtctgggtcatagcccacgagtgcggccaccacgccttcagcgactac

SEQ ID NO: 30113 - DNA, 350 bp, Artificial
  Mutation in BnaA.FAD2.a introduced by TALE nuclease pair BnFAD2_T03
caggatccatgggtggcaggtggaagaatgcaagtctctcctccctccagctcccccggaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30114 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccgtcgtctgggtcatagcccacgagtgcggccaccacgcctgcagcgactac

SEQ ID NO: 30115 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30116 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 30117 - DNA, 351 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30118 - DNA, 334 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcccaccgcactgtttcaaacgctagatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30119 - DNA, 350 bp, Artificial
  Mutation in BnaA.FAD2.a introduced by TALE nuclease pair BnFAD2_T03
caggatccatgggtgcaggtggaagaacgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30120 - DNA, 348 bp, Artificial
  Mutation in BnaA.FAD2.a introduced by TALE nuclease pair BnFAD2_T03
caggatccattggtgcaggtggaagaatgcaagtgtctcctccctccaagaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 30121 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 30122 - DNA, 327 bp, Artificial
  Mutation in BnaA.FAD2.a introduced by TALE nuclease pair BnFAD2_T03
caggatccatgtgtgcaggtggaagaatgcaagtgtctcctccctccaaaaagtctgaaaccgacaacatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30123 - DNA, 355 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgcggagaactcaagaaagcaatcccaccgcactgtttcaaacgctcgattcctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30124 - DNA, 369 bp, Artificial
  Mutation in BnaA.FAD2.a introduced by TALE nuclease pair BnFAD2_T03
caggatccagggtgcaggtggaagaatgcaagtgtctcctccctccaaaaagtctgaaaccgacaacatcaagcgcgtaccctgcgagacaccgcccttcactgtcggtgaacgctctcctgagtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 30125 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30126 - DNA, 350 bp, Artificial
  Mutation in BnaA.FAD2.a introduced by TALE nuclease pair BnFAD2_T03
caggatccatgggtgcaggtggaagcatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 30127 - DNA, 380 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30128 - DNA, 435 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcatcctcacctcctccagggtcagggtgccggcctttggtggcaagcaggcgctggagacggtccagcggctgttgccggtgcggagaactcaagaaagcaatcccaccgcactgtttcaaacgctcgatccctcgctatttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30129 - DNA, 414 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaggcgctggagacggtccagcggctgttgccggtgctgtgccaggcccacggcttgaccccggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30130 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatcgcccacgaatgcggccaccacgccttcagcgactac

SEQ ID NO: 30131 - DNA, 334 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30132 - DNA, 349 bp, Artificial
  Mutation in BnaA.FAD2.a introduced by TALE nuclease pair BnFAD2_T03
caggatccatgggtgcagtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctggcctctctactgggcctgccaagggtgcgtcctaaccggcgtctgggtcatagcccacgagtgcggccaccacgccatcagcgactac

SEQ ID NO: 30133 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcggggctgcgtcctaaccggcgtctgggtcatagcccacgagtgcggccaccacgccttcagcgactac

SEQ ID NO: 30134 - DNA, 319 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 30135 - DNA, 350 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactcggcctgccaagggtgcgtcctaaccggcgtctgggtcatagcccacgagtgcggccaccacgccctcagcgactac

SEQ ID NO: 30136 - DNA, 350 bp, Artificial
  Mutation in BnaA.FAD2.a introduced by TALE nuclease pair BnFAD2_T03
caggatccatgggtgcaggtgggagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 30137 - DNA, 329 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcatcccaccgcactatttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30138 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatccctcgctccttctcctacctactcttcgacatcctcgtctcctcctccctctaccacctctccacagcctacttccctctcctcccccaccctctcccttccctcgcctggcccctctactgggcctgccagggctgcgtcctaaccggcgtctgggtcatagcccacgagtgcggccaccacgccttcagcgactac

SEQ ID NO: 30139 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 30140 - DNA, 358 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggcggagaactcaagaaagcaatcccaccgcactgtttcaaccgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30141 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30142 - DNA, 465 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggaccgagatagggttgagtgttgttccagtttggaacaagagtccactattaaagaacgtggactccaacgtcaaagggcgaaaaaccgtctatcagggcgatggttcacgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30143 - DNA, 463 bp, Artificial
  Mutation in BnaA.FAD2.a introduced by TALE nuclease pair BnFAD2_T03
caggatccatgggtgcaggtgcaagaatgcaagtctctcctccctccagctcccccgaaaccaaaaccctcaaacgcgtcccctgcgagacaccacccttcacaccacctgctccggggtcaagccgtgggcctggcacagcaccggcaacagcgcctgcaccgtctccagcgcctgcttgccaccaatattgctggcgatggccaccacctgctccggagacctcaagaaagcaatcccacctcactgcttcaaacgctccatccctcgctccttctcctacctcatctgggacatcatcatagcctcctgcttctactacgtcgccaccacttactgcccgctccgccctcgccctctctcctacttcgcctggcctctctactgggcctgccagggctgcgtcctaaccggcgtctgggtcatagcccacgagtgcggccaccacgccttcagcgactac

SEQ ID NO: 30144 - DNA, 356 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggcggagacctcaagaaagcaatcccaccgcactgtttcaaacgctcgatccctcgctctttctcctacctcatctgggacatcatcatagcctcctgcttctactacgtcgccaccacttacttccctctcctccctcaccctcgctcctactgcgcctggcctctctactgggcctgccagggctgcgtcctaaccggcgtctgggtcatagcccacgagtgcggccaccacgccttcagcgactac

SEQ ID NO: 30145 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttgctccaagaactcaagaaagcaatcccaccgcactgtttcaaacgctcgatccctcgctctttctcctatctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30146 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30147 - DNA, 358 bp, Artificial
  Mutation in BnaA.FAD2.a introduced by TALE nuclease pair BnFAD2_T03
caggatccatgggtgcaggtggaagaatgcaagtgtctcctcccaccaagaagtctgaaaccgacaccatcaagcgcgtaccctgcgagacaccgcccttcactgtcggggcggagaactcaagaaagcaatcccaccgcactgtttcaaacgctcgatccctcgctctttctcctacctcatctgggacatcatcatagcctcctgcttctactacgtcgccaccacttacttccctctcctccctcacccgctctcctacttcgcctggcctctctactgggcctgccagggctgcgtcctaaccggcgtctgggtcatagcccacgagtgcggccaccacgccttcagcgactac

SEQ ID NO: 30148 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccggggctgcgtcctaaccggcgtctgggtcatagcccacgagtgcggccaccacgccttcagcgactac

SEQ ID NO: 30149 - DNA, 315 bp, Artificial
  Mutation in BnaA.FAD2.a introduced by TALE nuclease pair BnFAD2_T03
caggatccatgggtgcaggtggaagaatgcaagtctctcctccctcccgtccccccggaaacaacaccctcagacctcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 30150 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcataagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccctcagcgactac

SEQ ID NO: 30151 - DNA, 351 bp, Artificial
  Mutation in BnaA.FAD2.a introduced by TALE nuclease pair BnFAD2_T03
caggatccatgggtgcaggtggaagaatgcaagtatctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30152 - DNA, 439 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgtccttcactgtgtgccacgctgagagtcagcagcaaatgaaaaatctaaagggggtcaagccgtgggcctggcacagcaccggcaagcaggcgctggagaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30153 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaaccggcgtctgggtcatagcccacgagtgcggccaccacgccttcagcgactac

SEQ ID NO: 30154 - DNA, 280 bp, Artificial
  Mutation in BnaA.FAD2.a introduced by TALE nuclease pair BnFAD2_T03
caggatccatgggtgcaggtgcaagaatgcaagtgtctcctccctccaaaaagtctgaaaccgacaacatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30155 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgacgggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 30156 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30157 - DNA, 403 bp, Artificial
  Mutation in BnaA.FAD2.a introduced by TALE nuclease pair BnFAD2_T03
caggatccatgggtgcaggtggaagaatgcaagtctctcctccttccagctcccccggaaccaacaccctcaaacgcgtcccctgcgagacaccaccattcactagtcctgtcgggtttcgccacctctgacttgagcgtcgatttttgtgatgctcgtagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30158 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactaaaacaatcccaccgcactgtttcaaacgctcgatccctcgctctttctcctacctcatctgggacatcatcatagcctcctgcttctactacgtcgccaccacttacttccctctcccccctcaccctctctcctacttcgcctggcctctctactgggcctgccagggctgcgtcctaaccggcgtctgggtcatagcccacgagtgcggccaccacgccttcagctactac

SEQ ID NO: 30159 - DNA, 308 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30160 - DNA, 407 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtggacaccaaggcctactccggcggctacaacctgcccatcggccaggccgacgaagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 30161 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccccttacttccctctcctcccccaccctctcccttacctcgcctggcccctctactgggcctgccaaggctgcgtcctaacggacctctgggtcatcgcccacgagtgcggccaccacgccttcagcgactac

SEQ ID NO: 30162 - DNA, 331 bp, Artificial
  Mutation in BnaA.FAD2.a introduced by TALE nuclease pair BnFAD2_T03
caggatccatgggtgcaggtggaagaatgcaagtatctcctccctccagctcccccgaaaccaaaaccctcaaacgcgtcccctgcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30163 - DNA, 318 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30164 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccaccgcactttttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30165 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 30166 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 30167 - DNA, 388 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtaccctgcgagacaccgcccttcactgtcggggtcaagccgtgggcctggcacagcaccggcaagcaggcgctggagacgagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30168 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30169 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30170 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 30171 - DNA, 340 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgtgtcatagcccacgagtgcggccaccacgccttcagcgactac

SEQ ID NO: 30172 - DNA, 389 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggtttgtttgccggatcaagagctaccaactctttttccgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcggcctaaccggcgtctgggtcatagcccacgagtgcggccaccacgccttcagcgactac

SEQ ID NO: 30173 - DNA, 410 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggttcagcctggtcagctgggccttgtagttgcccttgaagtggccggacacgaacaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggtgtctgggtcatagcccacgagtgcggccaccacgccttcagcgactac

SEQ ID NO: 30174 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 30175 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcttagcctcctgcttctactacgtcgccaccacttacttccctctcctccctcaccctctctcctacttcgcctggcctctctactgggcctgccaagggtgcgtcctaacgggcctcttggtcatcgcccacgaatgcggccaccacgccttcagcgactac

SEQ ID NO: 30176 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30177 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30178 - DNA, 397 bp, Artificial
  Mutation in BnaA.FAD2.a introduced by TALE nuclease pair BnFAD2_T03
caggatccatgggtgcaggtggaagaatgcaagtgtcacctccctccaaaaagtctgaaaccgacaccatcaagcgcgtaccctgcgagacaccgcccttcactgagcaggtggtggccatcgccagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccactcacgtccctcccctcccccaccctctctcctacttcgcctggcccctctcctgggcctgccaaggctgcggcctaacgggcctctgggtcatagcccacgagtgcggccaccacgccttcagcgactac

SEQ ID NO: 30179 - DNA, 359 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggatcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgtgtcatagcccacgagtgcggccaccacgccttcagcgactac

SEQ ID NO: 30180 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagtgtgcgtcctaaccggcgtctgggtcatagcccacgagtgcggccaccacgccttcagcgactac

SEQ ID NO: 30181 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcagggctgcgtcctaaccggcgtctgggtcatagcccacgagtgcggccaccacgccttcagcgactac

SEQ ID NO: 30182 - DNA, 304 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30183 - DNA, 400 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctcggggtcaagccgtgggcctggcacagcaccggcaacagccgctggaccgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30184 - DNA, 350 bp, Artificial
  Mutation in BnaA.FAD2.a introduced by TALE nuclease pair BnFAD2_T03
caggatccatgggtgcaggtggaagaatgcaagtgtctccacactccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggtcctgccagggctgcgtcctagccggcgtctgggtcatagcccacgagtgcggccaccacgccttcagccactac

SEQ ID NO: 30185 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcaagaaagcaatcccacctcactgcttcaaacgctcgatccctcgctctttctcctacctcatctgggacatcatcatagcatcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30186 - DNA, 348 bp, Artificial
  Mutation in BnaA.FAD2.a introduced by TALE nuclease pair BnFAD2_T03
caggatccatgggtgcaggtggaagaatgcaagtgtcttctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 30187 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 30188 - DNA, 345 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30189 - DNA, 348 bp, Artificial
  Mutation in BnaA.FAD2.a introduced by TALE nuclease pair BnFAD2_T03
caggatccatgggtgcaggtggaacaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggtcaccacgccttcagcgacac

SEQ ID NO: 30190 - DNA, 279 bp, Artificial
  Mutation in BnaA.FAD2.a introduced by TALE nuclease pair BnFAD2_T03
caggatccatgggtgcaggtggaagaatgcaagtgtctcctccctccagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30191 - DNA, 410 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgactcaagacgatagttaccggataaggcgcagcggtcgggctgaacggggggtcgaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30192 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 30193 - DNA, 402 bp, Artificial
  Mutation in BnaA.FAD2.a introduced by TALE nuclease pair BnFAD2_T03
caggatccatggttgcaggtggaagaatgcaagtgtctcctccctccaaaaagtctgaaaccgacaccatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30194 - DNA, 309 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaaccgacaacacccaccgcactgtttcaaacgctcgatccctcgctctttctcctacctcatctgggacatcatcatagcctcctgcttctactacgttgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30195 - DNA, 347 bp, Artificial
  Mutation in BnaA.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctccttctcctacctcctcttcgacatcctcgtctcctcctccctctaccacctctccacagcctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30196 - DNA, 418 bp, Artificial
  Mutation in BnaA.FAD2.a introduced by TALE nuclease pair BnFAD2_T03
caggatccatgggtgcaggtggaagaatgcaagtctctcctccctccagctccccgaaaccaaaaccctcaaacgcgtcccctgcgagacaccacccttcactccggtccagcggctgttgccgccatcgtggctggcgatggccaccacctgctccggggtcaagccgtgggcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgtgtcatagcccacgagtgcggccaccacgccttcagcgactac

SEQ ID NO: 30197 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30198 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactagaacccaagaaagcaatccaaccgcactgtttcaaacgcccgatccctccctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30199 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30200 - DNA, 410 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgtacgtgccccacgagtacatcgagctgatcgagatcgcccagaacagcacccaggaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgacta

SEQ ID NO: 30201 - DNA, 342 bp, Artificial
  Mutation in BnaA.FAD2.a introduced by TALE nuclease pair BnFAD2_T03
caggatccatgggtgcaggtggaacaatgcaagtgtctcctcccttcaagaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30202 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgacta

SEQ ID NO: 30203 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatatcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30204 - DNA, 378 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggctgttgccggtgctgtgccaggcccagaactcaagaaagcaatcccaccgcactgtttcaaacgctcgatcccacgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30205 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttatcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30206 - DNA, 350 bp, Artificial
  Mutation in BnaA.FAD2.a introduced by TALE nuclease pair BnFAD2_T03
caggatccatgggtgcaggtggaagaatgcaagtctatccaccctccaaaaagtctgaaaccgacaacatcaagcgcgtaccctgcgagacaccgcccttcactgtagaactcaagaacgcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30207 - DNA, 343 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30208 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 30209 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctatttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30210 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttaaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30211 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcatggcctctctactgggcctgccagggctgcgtcctaaccggcgtctgggtcatagcccacgagtgcggccaccacgccttcagcgactac

SEQ ID NO: 30212 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctgaccctctctcctacttcgcctggcctctctactgggcctgccagggctgcgtcctaaccggcgtctgggtcatagcccacgagtgcggccaccacgccttcagcgactac

SEQ ID NO: 30213 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcgcgactac

SEQ ID NO: 30214 - DNA, 369 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtacggtggtttgtttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30215 - DNA, 372 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggtttcccgactggaaagcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30216 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggagcgtcctaaccggcgtctgggtcatagcccacgagtgcggccaccacgccttcagcgactac

SEQ ID NO: 30217 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttagttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30218 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 30219 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgtggccaccacgccttcagcgactac

SEQ ID NO: 30220 - DNA, 336 bp, Artificial
  Mutation in BnaA.FAD2.a introduced by TALE nuclease pair BnFAD2_T03
caggatccatgggtgcaggtggaagaatgcaagtgtcacctccctccaaaaagtctgaaaccgacaacatcaagcgcgtaccctgcgagacaccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 30221 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgaaaccatcaagcgcgtaccctgcgagacacctccctccaagcgcctcctccctcccaccgcaatgcttccaacgctcgatccctcactcttcctcctacctcacctgtcacatcatcatagcctcctgcttctactacgtctcccccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 30222 - DNA, 409 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaggcccacggcttgaccccggagcaggtggtggccatcgccagcaatattggtggcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30223 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggagcgtcctaaccggcgtctgggtcatagcccacgagtgcggccaccacgccttcagcgactac

SEQ ID NO: 30224 - DNA, 417 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagcggctgttgccggtgctgtgccaggcccacggcttgaccccggagcaggtggtggccatcgccagccacgatggcgggggagaactcaagaaagcaatcccaccgcactgtttcaaacgctcgatccctcgctctttctcctacctcatctgggacatcatcatagcctcctgcttctactacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30225 - DNA, 381 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgaggcatttctgtcctggctggtctagaggagaactcaagaaagcaatcccaccgcactgtttcaaacgctcgatccctcgctctttctcctacctcatctgggacatcatcatagcctcctgcttctactacgtcgccaccacttacgtccctctcctccctcaccctctctcctactgcgcctggcctctctactgggcctgccagggctgcgtcctaaccggcgtctgggtcatagcccacgagtgcggccaccacgccttcagcgactac

SEQ ID NO: 30226 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30227 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 30228 - DNA, 403 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgaaccttcggtttgatcttctcctgttgctcggctatgtgccaggccatgctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30229 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgttgctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30230 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30231 - DNA, 404 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcagagcccacgagtgcggccaccacgccttcagcgactac

SEQ ID NO: 30232 - DNA, 340 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtacggctgcggcgagcggagaactcaagaaagcaatcccaccgcactgttccaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30233 - DNA, 345 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30234 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggatatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttccagcgactac

SEQ ID NO: 30235 - DNA, 344 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccagggctgcgtcctaacgggcctctgggtcatagcccacgagtgcggccaccacgccttcaggatac

SEQ ID NO: 30236 - DNA, 352 bp, Artificial
  Mutation in BnaA.FAD2.a introduced by TALE nuclease pair BnFAD2_T03
caggatccatgggtgcaggtggaagaatgcaagtatatcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctggcctctctactgggcctgccagggctgcgtcctaacgggcctctgggtcatagcccacgagtgcggccaccacgccttcagcgactac

SEQ ID NO: 30237 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctgacccctctactgggcctgccaaggctgcgtcctaacgggcctctgggtcatcgcccacgaatgcggccaccacgccttcagcgactac

SEQ ID NO: 30238 - DNA, 351 bp, Artificial
  Mutation in BnaA.FAD2.a introduced by TALE nuclease pair BnFAD2_T03
caggatccatgggtgcaggtggaagaatgcaagtatctcctccctccaagaagtctgaaaccgacaccatcaagcgcgtaccctgcgagacaccgcccttcactgtcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30239 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30240 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggggcatagcccacgagtgcggccaccacgccttcagcgactac

SEQ ID NO: 30241 - DNA, 329 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30242 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30243 - DNA, 373 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacattaaccagctgcattaatgaatcggccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30244 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30245 - DNA, 402 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtccagcgcctgcttgccgccatcgtggctggcgatggccaccacctgctccgcagaactcaagaaagcaatcccaccgcactgtttcaaacgctcgatcccgcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatcgcccacgaatgcggccaccacgccttcagcgactac

SEQ ID NO: 30246 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30247 - DNA, 354 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30248 - DNA, 308 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggacaccacgccttcagcgactac

SEQ ID NO: 30249 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaaccttcggtttgatcttctcctgttgctcggctatgtgccaggccatgctagaactcacgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatatcccacgagtgcggccaccacgccttcagcgactac

SEQ ID NO: 30250 - DNA, 398 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtacttcaagtgtctcctccctccaaaaagtctgaaaccgacaacatacgcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggccatcgcccacgaatgcggccaccacgccttcagcgactac

SEQ ID NO: 30251 - DNA, 409 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgcactgacgggtgccccgctcaacttgaccccccagcaggtggtggccatcgccagcaataatggtggcaagcaatcccaccgcactgtttcaaacgctcgatccctcgctctttctcctacctcatctgggacatcatcatagcctcctgcttctactacgtctccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30252 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactatttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30253 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 30254 - DNA, 287 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30255 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30256 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacctccctccaagtgtctcctccctcccaccgcactgtttcaaacgctctatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcggccaccacgccttcagcgactac

SEQ ID NO: 30257 - DNA, 341 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaagcgcgtaccctgcgagacaccgcccttcactaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30258 - DNA, 283 bp, Artificial
  Mutation in BnaA.FAD2.a introduced by TALE nuclease pair BnFAD2_T03
caggatccatgggtgcaggtggaagaatgcaagtatctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 30259 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactgacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30260 - DNA, 295 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 30261 - DNA, 317 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatacgcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30262 - DNA, 307 bp, Artificial
  Mutation in BnaA.FAD2.a introduced by TALE nuclease pair BnFAD2_T03
caggatccatgggtgcaggtggtggccatcgccagccacgatggcggcaagcaggcgctggagagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30263 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccatgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtactaaccggcgtctgggtcatagcccacgagtgcggccaccacgccttcagcgactac

SEQ ID NO: 30264 - DNA, 391 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacccgcttcctcgctcactgactcgctgcgctcggtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 30265 - DNA, 323 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtagaactcaagaaagcaatcccaccgcactgtttcaaacgctcgatccctcgctctttctcctacctcatctgggacatcatcatagccttctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30266 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaatgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcacgactac

SEQ ID NO: 30267 - DNA, 330 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgacgggagaactcaagaaagcaatcccaccgcactgtttcaaacgctcgatccctcgctctttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 30268 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 30269 - DNA, 324 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcatcctctctcctacttcgcctggcctctctactgggcctgccagggctgcgtcctaaccggcgtctgggtcatagcccacgagtgcggccaccacgccttcagcgactac

SEQ ID NO: 30270 - DNA, 398 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggcgactgccctgctgcgtaacatcgttgctgctccataacatcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 30271 - DNA, 435 bp, Artificial
  Mutation in BnaA.FAD2.a introduced by TALE nuclease pair BnFAD2_T03
caggatccatgggtgcaggtggaagaatgcaagtgtctcctccctccaaaaagtcttaaaccgacaacatcaagcgcgtaccctgcgagacaccgcccttcactgtcatcctcacctcctccagggtcagggtgccggcctttggtggcaagcaggcgctggagacggtccagcggctgttgccggtgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30272 - DNA, 340 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgttcggctgcggcgagcggagaactcaagaaagcaatcccacctcactgcttcaaacgctcgatcccttgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30273 - DNA, 328 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30274 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaacgggcctctgggtcatagcccacgagtgcggccaccacgccttcagcgactac

SEQ ID NO: 30275 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgccgggcctcactactgggcctgccagggcggcggcctaaccggcgtcggggtcatagcccacgagtgcggccaccacgccttcagcgactac

SEQ ID NO: 30276 - DNA, 376 bp, Artificial
  Mutation in BnaA.FAD2.a introduced by TALE nuclease pair BnFAD2_T03
caggatcatggtgcaggtggaagaatgcaagtgtctcctccctccaaaaagtctgaaaccgacaacatcaagcgcgtaccctgcgagacaccgcccttcactgtcggctgttgccggtgctgtgccaggcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30277 - DNA, 357 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 30278 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgattgcggccaccacgccttcagcgactac

SEQ ID NO: 30279 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttctcctacctgatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30280 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcctctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 30281 - DNA, 379 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggccacgatggcggcaacagccgctggagggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30282 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30283 - DNA, 350 bp, Artificial
  Mutation in BnaA.FAD2.a introduced by TALE nuclease pair BnFAD2_T03
caggatccatgggtgcaggtggaagaacgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30284 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacttggcctgccaagggtgcgtcctaaccggcgtctgggtcatagcccacgagtgcggccaccacgccttcagcgactac

SEQ ID NO: 30285 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgcaagacagcaatcccaccgcactgtttcaaacgctcgatccctcgctctttctcctacctcatctgggacatcatcatagcctcctgcttctactacgtcgccaccacttacttccctcccctccctcaccctctgtcctacttcgcctggcctctctactgggcctgccagggctgcgtcctaaccggcgtctgggtcatagcccacgagtgcggccaccacgccttcagcgactac

SEQ ID NO: 30286 - DNA, 350 bp, Artificial
  Mutation in BnaA.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacaagtgcggccaccacgccttcagcgactac

SEQ ID NO: 30287 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttaggtacctcgcgaatgcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgggcctgccaagggtgcgtcctaacgggcctctgggtcatagcccacgagtgcggccaccacgccttcagcgactac

SEQ ID NO: 30288 - DNA, 354 bp, Artificial
  Mutation in BnaA.FAD2.a introduced by TALE nuclease pair BnFAD2_T03
caggatccatgggtgcaggtgcaagaatgcaagtgtctcctccctccaaaaagtctgaaaccgacaacatcaagcgcgtaccctgcgagacaccgcccttcactgtccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30289 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctcggggtcatcgcccacgaatgcggccaccacgccttcagcgactac

SEQ ID NO: 30290 - DNA, 409 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaggcccacggcttgaccccggagcaggtggtggccatcgccagcaatattggtggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30291 - DNA, 431 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtattggtaggagttaatattgccggtgaaagaaacataaggtaatcaagccgattcattttaagcggcctttcaagcaacaaaaatcacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30292 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 30293 - DNA, 356 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctaatgggcctgccagggctgcgtcctaaccggcgtctgggtcatagcccacgagtgcggccaccacgccttccgcgactac

SEQ ID NO: 30294 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttatttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30295 - DNA, 348 bp, Artificial
  Mutation in BnaA.FAD2.a introduced by TALE nuclease pair BnFAD2_T03
caggatccatgggtgcaggtggaagaatgcaagtgtatactccctccaaaaagtctgaaaccgacaacatcaagcgcgtaccctgcgagacaccgcccttcacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30296 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtcttaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30297 - DNA, 350 bp, Artificial
  Mutation in BnaA.FAD2.a introduced by TALE nuclease pair BnFAD2_T03
caggatccatgggtgcaggtggaagaatgcaagtgtctcctgcctccaaaaagtctgaaaccgacaacatcaagcgcgtaccctgcgagacaccgcccttcactgtagaactcaagaaagcaatcccaccgcactgtttcaaacgctcgatccctcgctcgttctcctacctcatctgggacatcatcatagcctcctgcttctactacgtcgccaccacttacttccctctcctccctcaccctctctcctacttcgcctggcctctctactgggcgtgccagggctgcgtcctaaccggcgtctgggtcatagcccacgagtgcggccaccacgccttcagcgactac

SEQ ID NO: 30298 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgacggagaactcaagaaagcaatcccaccgcactgtttcaaacgctcgatccctcgctctttctcctacctcatctgggacatcatcatagcctcctgcttctactacgtcgccaccacttacttccctctcctccctcgccctctctcctacttcgcctggcctctctactgggcctgccaagggtgcgtcctaaccggcgtctgggtcatagcccacgagtgcggccaccacgccttcagcgactac

SEQ ID NO: 30299 - DNA, 393 bp, Artificial
  Mutation in BnaA.FAD2.a introduced by TALE nuclease pair BnFAD2_T03
caggatccatgggcgcaggtggaagaatgcaagtgtctcctccctccaaaaagtctgaaaccgacaacatcaagcgcgtaccctgcgagacacgcctgcttgccaccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtcctaaccggcgtctgggtcatagcccacgagtgcggccaccacgccttcagcgactac

SEQ ID NO: 30300 - DNA, 346 bp, Artificial
  Mutation in BnaA.FAD2.a introduced by TALE nuclease pair BnFAD2_T03
cagatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30301 - DNA, 349 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 30302 - DNA, 283 bp, Artificial
  Mutation in BnaA.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccagggctgcgtcctaaccggcgtctgggtcatagcccacgagtgcggccaccacgccttcagcgactac

SEQ ID NO: 30303 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggtgtctgggtcatagcccacgagtgcggccaccacgccttcagcgactac

SEQ ID NO: 30304 - DNA, 401 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctccttctactccgccgccaccccttactcccctctcctccctcaccctctctcctactccgcctggcctctctactgggcctgccaagggtgcgtcctaaccggcgtctgggtcatagccaacgagtgcggccaccacgcctcagcgactac

SEQ ID NO: 30305 - DNA, 379 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactggtcatagcattggatcggatcccgggcccgagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 30306 - DNA, 348 bp, Artificial
  Mutation in BnaA.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30307 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctaccgggcctgccaagggtgcgtcctaaccggcgtctgggtcatagcccacgagtgcggccaccacgccttcagcgactac

SEQ ID NO: 30308 - DNA, 417 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccggccacttcaagggcaactacaaggcccagctgaccaggctgaaccacatcaccaactgcggagaactcaagaaagcaatcccaccgcactgtttcaaacgctcgatccctcgctctttctcctacctcatctgggacagcagcatagcctcctgcttctactacgtcgccaccacttacttccctctcccccctcaccctctctcctacttcgcctggcctctctactgggcctgccagggctgcgtcctaaccggcgtctgggtcatagcccacgagtgcggccaccacgccttcagcgactac

SEQ ID NO: 30309 - DNA, 282 bp, Artificial
  Mutation in BnaA.FAD2.a introduced by TALE nuclease pair BnFAD2_T03
caggatccatgggtgcaggtggtggggtcaagccgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30310 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctacgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcaaagcccacgagtgcggccaccacgccttcagcgactac

SEQ ID NO: 30311 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtacccttcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30312 - DNA, 351 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30313 - DNA, 419 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggcccacggcttgaccccccagcaggtggtggccatcgccagcaataatggtggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 30314 - DNA, 442 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttcgccagccacgatggcggcaagcaggcgccggagacggtccagcggctgttgccggtgctgtgccaggcccacggcttgaccccccagcagagaactcaagaaagcaatcccactgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30315 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 30316 - DNA, 344 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30317 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccacaacgccttcagcgactac

SEQ ID NO: 30318 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccagggctgcgtcctaaccggcgtctgggtcatagcccgcgagtgcggccaccacgccttcagcgactac

SEQ ID NO: 30319 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcataacccacgagtgcggccaccacgccttcagcgactac

SEQ ID NO: 30320 - DNA, 350 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 30321 - DNA, 382 bp, Artificial
  Mutation in BnaA.FAD2.a introduced by TALE nuclease pair BnFAD2_T03
caggatccatgggtgcaggctgaagaatgcaagtgtcccctccctccaaaaagtctgaaaccgacaacatcaagcgcgtaccctgcgagacaccgcccttcactgtacagccgctggaccgtctccagcgcctgtcggagaactcaagaaagcaatcccaccgcactgtttcaaacgctcgatccctcgctcgttctcctacctcatctgggacatcatcatagcctcctgcttctactacgtcgccaccacttacttcccgctcctccctcaccctctctcctacttcgcctagcctctctactgggcctgccaagggtgcgtcctaaccggcgtctggtgcatagcccacgagtgcggccaccacgccatcagcgactac

SEQ ID NO: 30322 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctttactgggcctgccagggctgcgtcctaaccggcgtctgggtcatagcccacgagtgcggccaccacgccttcagcgactac

SEQ ID NO: 30323 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctaccgggcctgccagggctgcgtcctaaccggcgtctgggtcatagcccacgagtgcggccaccacgccttcagcgactac

SEQ ID NO: 30324 - DNA, 328 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccagggctgcgtcctaaccggcgtctgggtcatagcccacgagtgcggccaccacgccttcagcgactac

SEQ ID NO: 30325 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaacacaagaaagcaatcccaccgcactgtttcaaacgctagatccctcgctctttctcctccctatctgggacatcatcatagcctcctgcttctactacgtcgccaccacttacttccctctcctccctcaccctctctcctacttcgcctggcccctctactgggcctgccagggctgcgtcctaaccggcgtctgggtcatcgcccacgaatgcggccaccacgccttcagcgactac

SEQ ID NO: 30326 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtcttaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30327 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcacgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30328 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30329 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgtgtcctaacgggcctctgggtcatcgcccacgaatgcggccaccacgccttcagcgactac

SEQ ID NO: 30330 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30331 - DNA, 393 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaaccggcgtctgggtcatagcccacgagtgcggccaccacgccttcagcgactac

SEQ ID NO: 30332 - DNA, 309 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacccacaacacccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttctgcgactac

SEQ ID NO: 30333 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgtagaactcaagaaagcaaccccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30334 - DNA, 351 bp, Artificial
  Mutation in BnaA.FAD2.a introduced by TALE nuclease pair BnFAD2_T03
caggatccatgggtgcaggtgcaagaatgcaagtgtatcctccctccaaaaagtctgaaaccgacaccatcaagcgcgtaccctacgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30335 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcagagcccacgagtgcggccaccacgccttcagcgactac

SEQ ID NO: 30336 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcaccatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30337 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccttccagggctgcgtcctaaccggcgtctgggtcatagcccacgagtgcggccaccacgccttcagcgactac

SEQ ID NO: 30338 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 30339 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 30340 - DNA, 351 bp, Artificial
  Mutation in BnaA.FAD2.a introduced by TALE nuclease pair BnFAD2_T03
caggatccatgggtgcaggtgcaagaatgcaagtgtctcctccctccaagaagtctgaaaccgacaccatcaagcgcgtaccctgcgagacaccgcccttcactgcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30341 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgagtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30342 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30343 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactaggtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30344 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 30345 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctccagcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30346 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcatacttcgcctggcctctctactgggcctgccagggctgcgtcctaaccggcgtctgggtcatagcccacgagtgcggccaccacgccttcagcgactac

SEQ ID NO: 30347 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30348 - DNA, 438 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttcgttggtcaacgcggccaacgccggatcagggcgagataactgggcaacaatgctctccagcgcctgttgccggtgctgtgccaggccgaactcaagaaagcaatcccaccgcactgtttcaaacgctcgatccctcgctctttctcctacctcacctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30349 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaactggcgtctgggtcatagcccacgagtgcggccaccacgccttcagcgactac

SEQ ID NO: 30350 - DNA, 278 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaaccggcgtctgggtcatagcccacgagtgcggccaccacgcctttcagcgactac

SEQ ID NO: 30351 - DNA, 333 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30352 - DNA, 342 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30353 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctccctctttctcctacctcatctaggacatcatcatagcctcctgcctctactacgtcgccaccacttacttccctctcctccctccccctctctcctacttcgcctggcctctctactgggcctgccaagggtgcgtcctaaccggcgtctgggtcatagcccacgagtgcggccaccacgccttcagcgactac

SEQ ID NO: 30354 - DNA, 348 bp, Artificial
  Mutation in BnaA.FAD2.a introduced by TALE nuclease pair BnFAD2_T03
caggatccatgggtgcaggttgaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagccgactac

SEQ ID NO: 30355 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcatcgactac

SEQ ID NO: 30356 - DNA, 348 bp, Artificial
  Mutation in BnaA.FAD2.a introduced by TALE nuclease pair BnFAD2_T03
caggatccatgggtgcaggtggaagtatgcaagtgtctcctccctccaagaagtctgaaaccgacaacatcaagcgcgtacccccagcaggtggtgaccatcgccagaactcaagaaagcaatcccaccgcactgttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30357 - DNA, 350 bp, Artificial
  Mutation in BnaA.FAD2.a introduced by TALE nuclease pair BnFAD2_T03
caggatccattggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 30358 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgcctggcctctctactgggcctgccagggctgcgtcctaaccggcgtctgggtcatagcccacgagtgcggccaccacgccttcagcgactac

SEQ ID NO: 30359 - DNA, 338 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30360 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaagaactcaagaaagcaatcccaccgcactgtttcaaacgctcgatccctcgctctttctcctacctcatctgggacatcatcatagcctccgcttctactacgtcgccaccacttacttccctctcctccctccccctctctcccttacctcgcctggcccctctactgggcctgccaaggctgcgtcctaacgggcctctgggtcatcgcccacgaatgcggccaccacgccttcagcgactac

SEQ ID NO: 30361 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgacta

SEQ ID NO: 30362 - DNA, 355 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 30363 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttctccgcccggcccctctactgggcctgccaagggtgcgtcctaaccggcgtctggctcataccccacgagtgcggcccccacgccttcagcgagtacctgt

SEQ ID NO: 30364 - DNA, 334 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcctcttcgacatcctcgtctcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30365 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30366 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30367 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactgcagacggtctcgatccctcgctctttctcctaccccatctgggacatcatcatagcctcctgcttctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 30368 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttggaagcaatcccaccgcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 30369 - DNA, 349 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30370 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgcctcaagaaagcaatcccaccgcactgtttcaaacgctcgatccctcgctctttctcctacctcatctgggacatcatcatagcctcctgcttctactacgtcgacaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30371 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30372 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttactcccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30373 - DNA, 349 bp, Artificial
  Mutation in BnaA.FAD2.a introduced by TALE nuclease pair BnFAD2_T03
caggatccattggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30374 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgcgcctgccaagggtgcgtcctaaccggcgtctgggtcatagcccacgagtgcggccaccacgccttcagcgactac

SEQ ID NO: 30375 - DNA, 347 bp, Artificial
  Mutation in BnaA.FAD2.a introduced by TALE nuclease pair BnFAD2_T03
caggatccatgggtgcaggtgaaagaatgcaagtgtgtccaccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 30376 - DNA, 347 bp, Artificial
  Mutation in BnaA.FAD2.a introduced by TALE nuclease pair BnFAD2_T03
caggatccatgggtgcaggtgaaagaatgcaagtgtatcccccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 30377 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacttggcctgccagggctgcgtcctaaccggcgtctgggtcatagcccacgagtgcggccaccacgccttcagcgactac

SEQ ID NO: 30378 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtaatagcccacgagtgcggccaccacgccttcagcgactac

SEQ ID NO: 30379 - DNA, 403 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgaaccttcggtttgatcttctcctgttgctcggctatgtgccaggccatgctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30380 - DNA, 333 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacaagaaagcaaccccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30381 - DNA, 309 bp, Artificial
  Mutation in BnaA.FAD2.a introduced by TALE nuclease pair BnFAD2_T03
caggatccatggggtgcaggtggaagaatgcaagtgtctcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30382 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30383 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggatcatagcccgcgagtgctgccaccgcgccatgagcaactac

SEQ ID NO: 30384 - DNA, 342 bp, Artificial
  Mutation in BnaA.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccacccttcactcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30385 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggggtctgggtcatagcccacgagtgcggccaccacgccttcagcgactac

SEQ ID NO: 30386 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgctgccaccacgccttcagcgactac

SEQ ID NO: 30387 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 30388 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30389 - DNA, 368 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagcaatggcggtggctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30390 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30391 - DNA, 430 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtattggtaggagttaatattacctaaaaagaaacataaggtaatcaagccgattcattttaagcggcctttcaagcaacaaaaatcacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30392 - DNA, 356 bp, Artificial
  Mutation in BnaA.FAD2.a introduced by TALE nuclease pair BnFAD2_T03
caggatccatggtgcaggtggaagaatgcaagtgtctcctccctccaaaaagtctgaaaccgacaacatcaagcgcgtaccctgcgagacaccccccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30393 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggcctctctactgggcctgccagggctgcgtcctaaccggcgtcggggtcatagcccacgagtgcggccaccacgccttcagcgactac

SEQ ID NO: 30394 - DNA, 397 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgagcaggtggtggccatcgccagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30395 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgcgacgcggagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 30396 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcacgcgcgtaccctgcgagacaccgcccttcactgtcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30397 - DNA, 304 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcaatcccaccgcactgtttcaaacgctcgatccctcgctctttctcctacctcatctgggacatcatcatagcctcctgcttctactacgttgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30398 - DNA, 351 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30399 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30400 - DNA, 339 bp, Artificial
  Mutation in BnaA.FAD2.a introduced by TALE nuclease pair BnFAD2_T03
caggatccatgggtgcaggtggaagaatgcaagtgcatcctccctccaaaaagtctgaaaccgacaacatcaagcgcgtaccctgcgagacaccgccctctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30401 - DNA, 395 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactggtggccatcgccagcaatggcggtggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30402 - DNA, 335 bp, Artificial
  Mutation in BnaA.FAD2.a introduced by TALE nuclease pair BnFAD2_T03
caggatccatgggtgcaggtggaagaatacaagtgtctcctccctccaaaaagtctgaaaccgacaacatcaagcgcgtaccctgcgagacaccgcccttcactgagaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30403 - DNA, 403 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaagcgcgtaccctgcgagacaccgcccttcactgtcgaaccttcggtttgatcttctcctgttgctcggctatgtgccaggccatgctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30404 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcttggtcatagcccacgagtgcggccaccacgccttcagcgactac

SEQ ID NO: 30405 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 30406 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30407 - DNA, 345 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttgagaactcaagaaagcaatcccaccgcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30408 - DNA, 456 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtaccacctgctggggggtcaagccgtgggcctggcacagcaccggcaacagccgctggaccgtctccagcgcctgcttgccaccattattgctggcgatggccaccaagaactcaagaaagcaatcccaccgcactgtttcaaacgctcgatccctcgctctttctcctacctcacctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30409 - DNA, 459 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcttgccctgacgagaaacaccagaacgggtagtgaattgcgcttgagatggtttaatttcaactttaatcattgtgaattaccttatgcgattttaagaactggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30410 - DNA, 347 bp, Artificial
  Mutation in BnaA.FAD2.a introduced by TALE nuclease pair BnFAD2_T03
caggtccatgggtgcaggtgcaagaatgcaagtgtctcctccctccaagaagtctgaaaccgacaccatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30411 - DNA, 371 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttttgacggggtcagtgccttaagtactcaagaaagcaatcccaccgcactgtttcaagcgctcggtccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30412 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccgagacctcaagaaagcaatcccaccgcactgtttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30413 - DNA, 308 bp, Artificial
  Mutation in BnaA.FAD2.a introduced by TALE nuclease pair BnFAD2_T03
caggatccatgggtgcaggcggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30414 - DNA, 308 bp, Artificial
  Mutation in BnaA.FAD2.a introduced by TALE nuclease pair BnFAD2_T03
caggatccatgggtgcaggtggaagaatgcaagtgtatcatccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 30415 - DNA, 330 bp, Artificial
  Mutation in BnaA.FAD2.a introduced by TALE nuclease pair BnFAD2_T03
caggatccatgggtgcggtggaagaatgcaagtctctcctccctccagctcccccgaaaccaaaaccctcaaacgcgtcccctgcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30416 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagtccacgagtgcggccaccacgccttcagcgactac

SEQ ID NO: 30417 - DNA, 350 bp, Artificial
  Mutation in BnaA.FAD2.a introduced by TALE nuclease pair BnFAD2_T03
cgatccatgggtgcaggtggaagaatgcaagtgtctcctccctccaaaaagtctgaaaccgacaacatcaagcgcgtaccctgcgagacaccgcccttactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttcgcctggcctctctactgggcctgccagggctgcgtcctaaccggcgtctgggtcatagcccacgagtgcggccaccacgccttcagcgactac

SEQ ID NO: 30418 - DNA, 340 bp, Artificial
  Mutation in BnaA.FAD2.a introduced by TALE nuclease pair BnFAD2_T03
caggatccagggtgcaggtggaagaatgcaagtgtcttctccctccaaaaagtctgaaaccgacaacatcaagcgcgtaccctgcgagacaccgcccttcactgtgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30419 - DNA, 325 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30420 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30421 - DNA, 351 bp, Artificial
  Mutation in BnaA.FAD2.a introduced by TALE nuclease pair BnFAD2_T03
caggatccatgggtgcagttggaagaatgcaagtgtctcctccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30422 - DNA, 345 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaacatcaagcgcgtaccctgcgagacaccgcccttgagaactcaagaaagcaatcccaccgcactgtttcaaacgctcgatccctcgctctttctcctacctcatctgggacatcatcatagcctcctgcttctactacgtcgccaccacttacatccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30423 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccaccgcactgtttcaaacgctcgatccctcgctctttctcctacctcatctgggacatcatcatagcctcctgcttctactacgtcgccaccacttacttcactctcctccctcaccctctctcctacttcgcctggcctctctactgggcctgccagggctgcgtcctaaccggcgtctgggtcatagcccacgagtgcggccaccacgccttcagcgactac

SEQ ID NO: 30424 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccacccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 30425 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtggtggccatcgccgtgggcctggcacagcaccggcaacagccgctggaccgtctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30426 - DNA, 316 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaatatttaccttccctccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30427 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30428 - DNA, 351 bp, Artificial
  Mutation in BnaA.FAD2.a introduced by TALE nuclease pair BnFAD2_T03
caggatccatgggtgcaggtggaagaatgcaagtgtctcatccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctggcctctctactgggcctgccagggctgcgtcctaaccggcgtcggggtcatagcccacgagtgcggccaccgcgccatcagcgactac

SEQ ID NO: 30429 - DNA, 383 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgagcaggtggtggccatcgccagccacgatggcggcaagcaggcgctggagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30430 - DNA, 348 bp, Artificial
  Mutation in BnaA.FAD2.a introduced by TALE nuclease pair BnFAD2_T03
caggatccatgggtgcagggggaagaatgcaagtgtctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccgccacgccttcatcgactac

SEQ ID NO: 30431 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgagtgcggccaccacgccttcagcgactac

SEQ ID NO: 30432 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtgccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30433 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtctggcctctctactgggcctgccagggctgcgtcctaaccggcgtctgggtcatagcccacgagtgcggccaccacgccttcagcgactac

SEQ ID NO: 30434 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacatcatcaagcgcgtaccctgcgagacaccgcccttcactgaactcaagaaagcaatcccaccgcactgtttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30435 - DNA, 347 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcatcgactac

SEQ ID NO: 30436 - DNA, 349 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggatgcgtcctaaccggcgtctgggtcatagcccacgagtgcggccaccacgccttcagcgactac

SEQ ID NO: 30437 - DNA, 372 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgctcacatgttctttcctgcgttatcccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccagggctgcgtcctaaccggcgtctgggtcatagcccacgagtgcggccaccacgccttcagcgactac

SEQ ID NO: 30438 - DNA, 347 bp, Artificial
  Mutation in BnaA.FAD2.a introduced by TALE nuclease pair BnFAD2_T03
caggatccatgggtgcaggtggaagaatgcaagtgtttcctccctccaagaagtctgaaaccgacaccatcaagcgcgtaccctgcgagacaccgcccttcactgaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggacatagcccacgaatgcggccaccacgccatcagcgactac

SEQ ID NO: 30439 - DNA, 348 bp, Artificial
  Mutation in BnaA.FAD2.a introduced by TALE nuclease pair BnFAD2_T03
caggatccatgggtgcaggtggaagaatgcaagtgtatcctcactccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30440 - DNA, 350 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 30441 - DNA, 344 bp, Artificial
  Mutation in BnaA.FAD2.a introduced by TALE nuclease pair BnFAD2_T03
caggatccatgggtgcaggcggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcctcttcgacatcctcgtctcctcctcggctcctccctctaccacctctccacagccttcttccctctcccttacctcacctggcccctctacggggcctgccaaagctgcgtcctaacgggcctctggggcatagcccacgagtgcggccaccgcgccttcagcgactgc

SEQ ID NO: 30442 - DNA, 352 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccaccgcactgtttcaaacgctcgatcccacgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30443 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30444 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30445 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30446 - DNA, 349 bp, Artificial
  Mutation in BnaA.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactcaagacctcaagaaagcaatcccaccgcactgtttcaaacgctcgatccctcgctctttctcctacctcatctgggacatcatcatagcctcctgcttctactacgtcgcaccacttacttccctctcctccctcaccctctctcctacttcgcctggcctctctactgggcctgccagggctgcgtcctaaccggcgtctgggtcatagcccacgagtgcggccaccacgccttcaacgactac

SEQ ID NO: 30447 - DNA, 448 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagcgcctgcttgccgccatcgtggctggcgatggccaccacctgctccggggtcaagccgtgggcctggcacagcacctgcaacagccgctggacggagacctcaagaaagcaatcccacctcactgcttcaaacgctcgatccctcgctctttcacctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30448 - DNA, 340 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccgtcagcgactac

SEQ ID NO: 30449 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30450 - DNA, 347 bp, Artificial
  Mutation in BnaA.FAD2.a introduced by TALE nuclease pair BnFAD2_T03
caggatccatgggtgcagggggaagaatgcaagtgtctcctccctccaaaaagtctgaaaccgacaccatcaagcgcgtaccctgcgagacaccgcccttcactgaactcaagaaagcaatcccaccgcactgtttcaaacgctctatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgctgccaccacgccttcagcgactac

SEQ ID NO: 30451 - DNA, 411 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgtacgtgccccacgagtacatcgagctgatcgagatcgcccggaacagcacccaggaccggagaactcaagaaagcaatcccaccgcactgtttcaaacgctcgatccctcgctctttctcctacctcatctgggacatcatcatagcctcctgcttctactacgtcgccaccacttacttccctctccgccctcaccctctctcctacttcgcctggcctctctactgggcctgccagggctgcgtcctaaccggcgtctgggtcatagcccacgagtgcggccaccacgccttcagcgactac

SEQ ID NO: 30452 - DNA, 350 bp, Artificial
  Mutation in BnaA.FAD2.a introduced by TALE nuclease pair BnFAD2_T03
caggatccatgggtgcaggtggaagaatgcaagtgtttcctcccttcaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30453 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30454 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatagcccacgagggcggccaccacgccttcagcgactac

SEQ ID NO: 30455 - DNA, 331 bp, Artificial
  Mutation in BnaA.FAD2.a introduced by TALE nuclease pair BnFAD2_T03
caggatccatgggtgcaggtagaagaatgcaagtgtctcctccctccaaaaagtctgaacccgacaacatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggtcctgccagggctgcgtcctaaccggctgctgggtcatagcccacgagggcggccaccacgccagcagcgactac

SEQ ID NO: 30456 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 30457 - DNA, 306 bp, Artificial
  Mutation in BnaA.FAD2.a introduced by TALE nuclease pair BnFAD2_T03
caggatccatgggtgcaggtggaagaatgcaagtctctcctccctccagctcccccggaaccaaaaccctcaaacgcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30458 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgatac

SEQ ID NO: 30459 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 30460 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 30461 - DNA, 396 bp, Artificial
  Mutation in BnaA.FAD2.a introduced by TALE nuclease pair BnFAD2_T03
caggatccatgggtgcaggcggaagaatgcaagtgtctcctccctccaaaaagtctgaaaccgacaacatcaagcgcgtaccctgcgagacaccgcccttcactgtcggttcctggccttttgctggccttttgctcacatgttctttccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30462 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcatgccagggctgcgtcctaaccggcgtctgggtcatagcccacgagtgcggccaccacgccttcagcgactac

SEQ ID NO: 30463 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 30464 - DNA, 382 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtacagccgctggaccgtctccagcgcctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30465 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgcccgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 30466 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcgtctgggtcatagcccacgagtgcggccaccacgccttcagcgactac

SEQ ID NO: 30467 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtacccttcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30468 - DNA, 343 bp, Artificial
  Mutation in BnaA.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgccattcactgtaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30469 - DNA, 463 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggttgcaagcaggcgctggagacggtccagcggctgtttgccaccaatattgctggcgatggccaccacctgctccggggtcaagccgtgggcctggcacagcaccggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30470 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcacttcttccaccgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 30471 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 30472 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaataaagcaatcccaccgcactgtttcaaacgctcgatccctcgctctttctcctacctcctcttcgacatcctcgtctcctcctccctctaccacctctccacagcctacttccctctcctccctcaccctctctcctacttcgcctggcctctctactgggccggccagggctgcgtcctaaccggcgtctgggtcatagcccacgagggcggccaccacgccttcagcgactac

SEQ ID NO: 30473 - DNA, 349 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgacac

SEQ ID NO: 30474 - DNA, 357 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctccgccggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30475 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 30476 - DNA, 355 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30477 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcatcctaaccggcgtctgggtcatagcccacgagtgcggccaccacgccttcagcgactac

SEQ ID NO: 30478 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacttggcctgccagggctgcgtcctaaccggcgtctgggtcatagcccacgagtgcggccaccacgccttcagcgactac

SEQ ID NO: 30479 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctgcgagaactcaagaaagcaatcccaccgcactgtttcaaacgctcgatacctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30480 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccgccacgcctgcagcgactac

SEQ ID NO: 30481 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30482 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 30483 - DNA, 411 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtcggaccggcgcacgcgctctggaggccttgctcacggtggcgggagagttgagaggtccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30484 - DNA, 348 bp, Artificial
  Mutation in BnaA.FAD2.a introduced by TALE nuclease pair BnFAD2_T03
caggatccatgggtgcaggtggaagaatgcaagtgtctcatccctccaagaagtctgaaaccgacaccatcaagcgcgtaccctgcgagacactgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcggcctaaccggcgtctgggtcatagcccacgagtgctgcgaccgcgccatcagcgactac

SEQ ID NO: 30485 - DNA, 341 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatcgcccacgaatgcggccaccacgccttcagcgactac

SEQ ID NO: 30486 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccagggctgcgtcctaaccggcgtctgggtcatagcccacgagtgcggccaccacgccttcagcgactac

SEQ ID NO: 30487 - DNA, 325 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30488 - DNA, 351 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtgagaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30489 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcactgtttcaaacgctcgatccctcgctctttctcctacctcatctgggacatcatcatagcctcctgcttctactacgtcgccaccacttacttccctctcctccctcgccctctctcctacttcgcctggcctctctactgggcctgccagggctgcgtcctaaccggcgtctgggtcatagcccacgagtgcggccaccacgccttcagcgactac

SEQ ID NO: 30490 - DNA, 280 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 30491 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagccccctgcttctactacgtcgccaccgcttacttccctctcctccctcaccctctctcctacctcgcctggcctctctactgggcctgccagggctgcgtcctaaccggcgtctgggtcatagcccacgagtgcggccaccacgccttcagcgactac

SEQ ID NO: 30492 - DNA, 317 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatacgcaaactcaagaaagcaatcccaccgcactgtttcaaacgctcgatccctcgctctctctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30493 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctacgagacaccgcccttcactgtagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30494 - DNA, 287 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30495 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 30496 - DNA, 352 bp, Artificial
  Mutation in BnaA.FAD2.a introduced by TALE nuclease pair BnFAD2_T03
caggatcccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30497 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtcccctgcgagacaccacccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatagcccacgagtgcggccaccacgccttcagcgactac

SEQ ID NO: 30498 - DNA, 340 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 30499 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccttctctcctacttcgcctggcctctctactgggcctgccagggctgcgtcctaaccggcgtctgggtcatagcccacgagtgcggccaccacgccttcagcgactac

SEQ ID NO: 30500 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatacctcgctctttctcctacctcatctgggacatcatcatagcctcctgcttctactacgtcgccaccacttacttccctctcctccctaaccctctctcctacttcgcctggcctctatactgggcctgccagggctgcgtcctaaccggcgtctgggtcatagcccacgagtgcggccaccacgccttcagcgactac

SEQ ID NO: 30501 - DNA, 404 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaccatcaagcgcgtaccctgcgagacaccgcccttcactgtctccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttctactccgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30502 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacctcatcatagcctcctgcttctactacgtcgccaccacttacttccctctcctccctcaccctctctcctacttcgcctggcctctctactgggcctgccagggctgagtcctaaccggcgtctgggtcatagcctacgagtgcggccaccacgccttcagcgactac

SEQ ID NO: 30503 - DNA, 308 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30504 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccttcagcgactac

SEQ ID NO: 30505 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctacttcgcctggcctctctactgggcctgccaagggtgcgtcctaaccggcgtctgggtcatagcccacgagtgcggccaccacgccttcagcgactac

SEQ ID NO: 30506 - DNA, 350 bp, Artificial
  Mutation in BnaA.FAD2.a introduced by TALE nuclease pair BnFAD2_T03
caggatccatgggtgcaggcggaagaatgcaagtgtatcatccctccaaaaagtctgaaaccgacaacatcaagcgagtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctatcctacttcgcctggcccctctactgggcctgccaaggctgcgtcctaacgggcctctgggtcatcgcccacgaatgcggccaccacgccttcagcgactac

SEQ ID NO: 30507 - DNA, 350 bp, Artificial
  Mutation in BnaA.FAD2.a introduced by TALE nuclease pair BnFAD2_T03
caggatccatgggtgcaggtggaagaatgcaagtgcatcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctggcctctctactgggcctgccaagggtgcgtcctaaccggcgtctgggtcatagcccacgattgcggccaccacgccttcagcgactac

SEQ ID NO: 30508 - DNA, 408 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggacttcgctgctacccaaggttgccgggtgacgcacaccgtggaaacggatgaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30509 - DNA, 337 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30510 - DNA, 354 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgtcggaagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30511 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcactcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 30512 - DNA, 436 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagacctttcacgtagtggacaaattcttccaactgatctgcgcgcgaggccaagcgatcttcttcttgtccaagataagcctgtctagaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30513 - DNA, 373 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactgccaggcatcaaactaagcagaaggccatccgtcaaacgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttgcctctctactgggcctgccagggctgcgtcctaaccggcgtctgggtcatagcccacgagtgcggccaccacgccttcagcgactac

SEQ ID NO: 30514 - DNA, 385 bp, Artificial
  Mutation in BnaA.FAD2.a introduced by TALE nuclease pair BnFAD2_T03
caggatccatgggtgcaggtggaagagtgcaagtgtctcctccctccaagaagtctgaaaccgacaccatcaagcgcgtaccctgcgagacaccgcccttcacgaggcttgttgtgaagggattccaacaaaaagtaggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 30515 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatcgcccacgaatgcggccaccacgccttcagcgactac

SEQ ID NO: 30516 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctaccacctctccacagcctacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 30517 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 30518 - DNA, 346 bp, Artificial
  Mutation in BnaA.FAD2.a introduced by TALE nuclease pair BnFAD2_T03
caggatccatgggtgcaggtggaagaatgcaagtgtctcctcccaccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30519 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30520 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 30521 - DNA, 351 bp, Artificial
  Mutation in BnaA.FAD2.a introduced by TALE nuclease pair BnFAD2_T03
caggatccatgggtgcagctcgaagaatgcaagtgtctcctccctccaagaagtctgaacccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggggcatagcccacgagtgcggccaccacgccttcagcgactac

SEQ ID NO: 30522 - DNA, 357 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30523 - DNA, 349 bp, Artificial
  Mutation in BnaA.FAD2.a introduced by TALE nuclease pair BnFAD2_T03
caggatccatgggtgcaggtcgaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30524 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcctctctactgggcctgccagggctgcgtcctaaccggcgtctgggtcatagcccacgagtgcggccaccacgccttcagcgactac

SEQ ID NO: 30525 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctagatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30526 - DNA, 402 bp, Artificial
  Mutation in BnaA.FAD2.a introduced by TALE nuclease pair BnFAD2_T03
caggatccatgggtgcaggtggaagaatgcaagtgtctccttcctccaaaaagtctgaaaccgacaacatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30527 - DNA, 333 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 30528 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcttggtcatagcccacgagtgcggccaccacgccttcagcgactac

SEQ ID NO: 30529 - DNA, 397 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagcaggtggtggccatcgccagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggtctgccaagggtgcgtcctaaccggcgtctgggtcatagcccacgagtgcggccaccacgccttcagcgactac

SEQ ID NO: 30530 - DNA, 348 bp, Artificial
  Mutation in BnaA.FAD2.a introduced by TALE nuclease pair BnFAD2_T03
caggatccatgggtgcaggtagaagaatgcaagtgtctcctccctccaagaagtctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgtgtcatagcccacgagtgcggccaccacgccttcagcgactac

SEQ ID NO: 30531 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 30532 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctagcccctctacggggcctgccaaggctgcgtcctaacgggcctctgggtcatcgcccacgagtgcggccaccacgccttcagcgactac

SEQ ID NO: 30533 - DNA, 351 bp, Artificial
  Mutation in BnaA.FAD2.a introduced by TALE nuclease pair BnFAD2_T03
caggatccatgggtgcaggtggaagaatgcaagtgtctcctcgctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacttggcctgccagggctgcgtcctaaccggcgtctgggtcatagcccacgagtgcggccaccacgccttcagcgactac

SEQ ID NO: 30534 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgagtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30535 - DNA, 319 bp, Artificial
  Mutation in BnaA.FAD2.a introduced by TALE nuclease pair BnFAD2_T03
caggatccatgggtgtaggcggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggggcatagcccacgagtgcggccaccacgccttcagcgactac

SEQ ID NO: 30536 - DNA, 456 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggctgttgccggtgctgtgccaggcccacggcttgaccccggagcaggtggtggccatcgccagcaatattggtggcaagcaggcgctggagacggtgcaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggtgtctgggtcatagcccacgagtgcggccaccacgccttcagcgactac

SEQ ID NO: 30537 - DNA, 350 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcctctctactgggcctgccagggctgcgtcctaaccggcctctgtgtcatcgcccacgaatgcggccaccacgccttcagcgactac

SEQ ID NO: 30538 - DNA, 408 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggacttcgctgctacccaaggttgccgggtgacgcacaccgtggaaacggatgaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30539 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtcccctgcgagacaccccccttcactgactcaagaaagcaatcccaccgcactgtttcaaacgctcgatccctcgctctttctcctacctcatctgggacatcatcatagcctcctgcttctactacgtcgccaccacttacttccctctcccccctcaccctctctcctacttcgcctggcctctctactgggcctgccagggctgcgtcctaaccggcgtctgggtcatagcccacgagtgcggccaccacgccttcagcgactac

SEQ ID NO: 30540 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaacgcctgaaaccgacaacctcaagcgcgtaccctgcgagacaccgcccttcaactcaagaaagcaaacccaccgcactctttcaaacggtcgaaccctcgctctttcacccacctcatctgggacatcatcatagcctcctgcttctactacgtcgccaccacttacttccctctcccccctcaccctctctcctacctcgcctggcctctctactgggcctgccaagggtgcgtcctaaccggcctctgggtcatagcccacgagtgcggccaccacgccttcagcgactac

SEQ ID NO: 30541 - DNA, 348 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcggctgggtcatagcccacgagtgcggccaccacgccttcagcgactac

SEQ ID NO: 30542 - DNA, 368 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagcaatggcggtggctggagaactcaagaaaggaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30543 - DNA, 370 bp, Artificial
  Mutation in BnaA.FAD2.a introduced by TALE nuclease pair BnFAD2_T03
caggatccatgggtgcaggtggaagaatgcaagtgtctcctccctccaagacgcctgaaaccgacaccatcaagcgcgtaccctgcgagacaccacccttcactggcaagcaggcgctgaaaacagagaactcacgaaagcaatcccaccgcactgcttcaaacgctcgatccctcgctctttctcctacctcatcttggacatcatcatcgccccctccctctactacgtcgccaccacttacttccctctcctcccccaccctctcccctacctcgcctggcctctctactgggcctgccagggctgcgtcctaaccggcgtctgggtcatagcccacgagtgcggccaccacgccttcagcgactac

SEQ ID NO: 30544 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30545 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaaacccaccgcactgtttcaaacgctcgatccctcgctctttctcctacctcatctgggacatcatcatagcctcctgcttctactacgtcgccaccacttacctccctctcctccctcaccctctctcctacttcgcctggcctctctactgggcctgccaagggtgcgtcctaaccggcgtctgggtcatagcccacgagggcggccaccacgccttcagcgactac

SEQ ID NO: 30546 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtctccagcgcctgcttgccgccatcgtggctggcgatggccaccacctgctccggactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30547 - DNA, 342 bp, Artificial
  Mutation in BnaA.FAD2.a introduced by TALE nuclease pair BnFAD2_T03
caggatccatggatgcaggtggaagaatgcaagtgtctactccctccaaaaagtctgaaaccgacaacatcaagcgcgtaccctgcgagacacctccctccaagtgtctcctccctcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 30548 - DNA, 345 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccgcgagtgctgcctccacgccttcagcgactac

SEQ ID NO: 30549 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 30550 - DNA, 421 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgcaccggcaacagccgctggaccgtctccagcgcctgcttgccgccatcgtggctggcgatggccaccacctgaactcaagaaagcaatcccaccgcactgtttcaaacgctcgatccctcgctctttctcctacctcatctgggacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 30551 - DNA, 462 bp, Artificial
  Mutation in BnaA.FAD2.a introduced by TALE nuclease pair BnFAD2_T03
caggatccatgggtgcaggcggaagaatgcaagtgtctcctcactccaaaaagtctgaaaccgacaccatcaagcgcgtaccctgcgagacaccgcccttcactgtcgccataaactgccaggcatcaaactaagcagaaggccatccgtctccagcgcctgcttgccaccgccattgccaggcccacggcttgaccccccagcaggtggtggccattagaactcaagaaagcaatcccaccgcactgtttcaaacgctcgatccctcgctctttcgcctacctcatctgggacatcatcatagcctcctgctgctactacgtcgccaccacttacttccctctcctccctcaccctctctcctacttcgcctggcctctctaccgggcctgccagggctgcgtcctaaccggcgtctgggtcatagcccacgagtgcggccaccacgccttcagcgactac

SEQ ID NO: 30552 - DNA, 336 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30553 - DNA, 315 bp, Artificial
  Mutation in BnaA.FAD2.a introduced by TALE nuclease pair BnFAD2_T03
caggatccatgggtgcaggtggaagaatgcaagtctctcctccctcccgtccccccggaaacaacaccctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30554 - DNA, 400 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcaccggcaacagccgctggaccgtctccagcgcctgcttgccaccagagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30555 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaattccaccgcactgttccaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgtgtcctaaccggcgtctgggtcatagcccacgagtgcggccaccacgccttcagcgactac

SEQ ID NO: 30556 - DNA, 345 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgtgtcatagcccacgagtgcggccaccacgccttcagcgactac

SEQ ID NO: 30557 - DNA, 308 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgctgccaccacgccttcagcgactac

SEQ ID NO: 30558 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgttctaaccggcgtctgggtcatagcccacgagtgcggccaccacgccttcagcgactac

SEQ ID NO: 30559 - DNA, 345 bp, Artificial
  Mutation in BnaA.FAD2.a introduced by TALE nuclease pair BnFAD2_T03
caggccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30560 - DNA, 279 bp, Artificial
  Mutation in BnaA.FAD2.a introduced by TALE nuclease pair BnFAD2_T03
caggatccatgggtgcaggtggaagaatgcaagtctctcctccctccagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30561 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagagtgcgtcctaaccggcgtcggggtcatagcccacgagtgcggccaccacgccttcagcgactac

SEQ ID NO: 30562 - DNA, 331 bp, Artificial
  Mutation in BnaA.FAD2.a introduced by TALE nuclease pair BnFAD2_T03
caggatccatgggtgcaggtggaagaatgcaagtgtctactcactccaaaaagtctgaaaccgacaacatcaagcgcgtcccctgcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30563 - DNA, 349 bp, Artificial
  Mutation in BnaA.FAD2.a introduced by TALE nuclease pair BnFAD2_T03
caggatccatgggtgcaggtggaagaatgcaagtgtgtcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30564 - DNA, 319 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtaatagcccacgagtgcggccaccacgccttcagcgactac

SEQ ID NO: 30565 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgattgcggccaccacgccttcagcgactac

SEQ ID NO: 30566 - DNA, 467 bp, Artificial
  Mutation in BnaA.FAD2.a introduced by TALE nuclease pair BnFAD2_T03
caggatccatgggtgcaggtggaagaatgcaagtgactcctccctccaagaagtctgaaaccgacaccatcaagcgcgtaccctgcgagacaccgcccttcactgtcagcggatttgaactactcaggagagcgttcaccgacaaacaacagataaaacgaaaggctcagtcttcctaattgcgtaccgccagccaggaagagtttgtagaaacgcaaaaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30567 - DNA, 348 bp, Artificial
  Mutation in BnaA.FAD2.a introduced by TALE nuclease pair BnFAD2_T03
caggatccatgggtgcaggtggaagaatgcaagtctctcctccctccaactcccccgaaaccaaaaccctcaaacgcgtcccctgcgagacaccacccttcactcgacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30568 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgacgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30569 - DNA, 430 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgctgtgcctggcccacggcttgaccccccagcaggtggtggccatcgccagcaatggcggtggcaagcaggcgctggagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30570 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtagaactcaagaaagcaatcccaccgcactgtttcaaacgctcgatccctcgctctttctcctacctcatctgcgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30571 - DNA, 318 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30572 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcggccaccacgccttcagcgactac

SEQ ID NO: 30573 - DNA, 308 bp, Artificial
  Mutation in BnaA.FAD2.a introduced by TALE nuclease pair BnFAD2_T03
caggatccatgggtgcaggtggaagaatgcaagtgtctcctccctcaaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30574 - DNA, 334 bp, Artificial
  Mutation in BnaA.FAD2.a introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcactgtatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcatcgactac

SEQ ID NO: 30575 - DNA, 350 bp, Artificial
  Mutation in BnaA.FAD2.a introduced by TALE nuclease pair BnFAD2_T03
caggatccatgggtgcaggtggaagtatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30576 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30577 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccaagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30578 - DNA, 349 bp, Artificial
  Mutation in BnaA.FAD2.a introduced by TALE nuclease pair BnFAD2_T03
caggatccatgggtgcaggtggaagaatgcaagtgactactccctcaaaaaagtctgaaaccgacaacataaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctagcctctctactgggcctgccaagggtgcgtccgaaccggcgtctgggtcatagcccacgagtgcggccaccacgccatcagcgactac

SEQ ID NO: 30579 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30580 - DNA, 379 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggccacgatggcgacaacagccgctggagggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30581 - DNA, 317 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatacgcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggttatagcccacgagtgcggccaccacgccttcagcgactac

SEQ ID NO: 30582 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggactgcggcctaaccggcgtctgggtcatagcccacgagtgcggccaccacgccttcagcgactac

SEQ ID NO: 30583 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggactgcgtcctaaccggcgtctgggtcatagcccacgagtgcggccaccacgccttcagcgactac

SEQ ID NO: 30584 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgattgcggccaccacgccttcagcgactac

SEQ ID NO: 30585 - DNA, 358 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagctactac

SEQ ID NO: 30586 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaacagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30587 - DNA, 307 bp, Artificial
  Mutation in BnaA.FAD2.a introduced by TALE nuclease pair BnFAD2_T03
caggatccatgggtgcaggtggaagaatgcaagtgtctcatccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcgggcaccacgcctcagcgactac

SEQ ID NO: 30588 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgccttcagcgactac

SEQ ID NO: 30589 - DNA, 317 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcctac

SEQ ID NO: 30590 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctgagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 30591 - DNA, 305 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30592 - DNA, 314 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagctcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30593 - DNA, 466 bp, Artificial
  Mutation in BnaA.FAD2.a introduced by TALE nuclease pair BnFAD2_T03
caggatccatgggtgcaggtggaagaatgcaagtgtctcccccctccaagaagtctgaaaccgacaccatcaagcgcgtaccctgcgagacaccgcccttcactgtggtccagcgcctgcttgccgccatcgtggctggcgatggccaccacctgctccggggtcaagccgtgggcctggcacagcaccggcaacagccgctggaccgtctccagcgcctggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccagggctgcggcctaaccggcgtctgggtcatagcccacgagtgcggccaccacgccttcagcgactac

SEQ ID NO: 30594 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagtgctgcgtcctaaccggcgtcttggtcatagcccacgagtgcggccaccacgccttcagcgactac

SEQ ID NO: 30595 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgccctaaccggcgtctgggtcatagcccacgagtgcggccaccacgccttcagcgactac

SEQ ID NO: 30596 - DNA, 459 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcttgccctgacgagaaacaccagaacgggtagtgaattgcgcttgagatggtttaatttcaactttaatcattgtgaattaccttatgcgattttaagaactggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30597 - DNA, 346 bp, Artificial
  Mutation in BnaA.FAD2.a introduced by TALE nuclease pair BnFAD2_T03
caggatccatgggtgcaggtggaagaatgcaagtgtctcctccctccaggacgcctgaaaccgacaccctcaaacgcgtaccctgcgagacaccgcccttcactctctcaagaaagcagtcccaccgcactgtttaaaacgctcgatccctcgctctttctcctacctcatctgtgacatcatcatagcctcctgcttctactacgtcgccacagcttacttccctctcctccctcaccctctctcctacttcgcctggcccctctactgggcctgccagggctgcgtcctaaccggcgtctgggtcatagcccacgagtgcggccaccacgccttcatcgactac

SEQ ID NO: 30598 - DNA, 396 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggttcctggccttttgctggccttttgctcacatgttctttccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 30599 - DNA, 342 bp, Artificial
  Mutation in BnaA.FAD2.a introduced by TALE nuclease pair BnFAD2_T03
caggatccatgggtgcaggtggaagaatgcaagtgtctcatccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30600 - DNA, 308 bp, Artificial
  Mutation in BnaA.FAD2.a introduced by TALE nuclease pair BnFAD2_T03
caggatccatgggtgcagatggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30601 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcggctgggtcatagcccacgagtgcggccaccacgccttcagcgactac

SEQ ID NO: 30602 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccatgcgagacaccacccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccagggctgcgtcctaaccggcgtctgggtcatagcccacgagtgcggccaccacgccttcagcgactac

SEQ ID NO: 30603 - DNA, 396 bp, Artificial
  Mutation in BnaA.FAD2.a introduced by TALE nuclease pair BnFAD2_T03
caggatccatgggtgcaggtggaagaatgcaagtgtctcatccctccaaaaagtctgaaaccgacaacatcaagcgcgtaccctgcgagacaccgcccttcactgtcggttcctggccttttgctggccttttgctcacatgttctttccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcggcctaaccggcgtcgggggcatagcccacgagtgcggccaccgcgccttcagcgactac

SEQ ID NO: 30604 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccacactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaggactgcgtcctaaccggcgactgggtcatagcccacgagtgcggccaccacgccttcagcgactac

SEQ ID NO: 30605 - DNA, 385 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtcgggtcagggtgccggccttgatcatctcgccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcggctgggtcatagcccacgagtgcggccaccacgccttcaacgactac

SEQ ID NO: 30606 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacctcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30607 - DNA, 351 bp, Artificial
  Mutation in BnaA.FAD2.a introduced by TALE nuclease pair BnFAD2_T03
caggatccatgggtgcaggtcgaagaatgcaagtctctcccccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30608 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcgtccaccacgccttcagcgactac

SEQ ID NO: 30609 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgtgtcatagcccacgagtgcggccaccacgccttcagcgactac

SEQ ID NO: 30610 - DNA, 349 bp, Artificial
  Mutation in BnaA.FAD2.a introduced by TALE nuclease pair BnFAD2_T03
caggatccatgggtgcaggtggaagaatgcaagtgtctcctccctcccaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30611 - DNA, 345 bp, Artificial
  Mutation in BnaA.FAD2.a introduced by TALE nuclease pair BnFAD2_T03
caggatccatgggtgcaggtgaaagaatgcaagtgtctcctccctcaaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30612 - DNA, 402 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgagtgcggccaccacgccttcagcgactac

SEQ ID NO: 30613 - DNA, 349 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30614 - DNA, 343 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 30615 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30616 - DNA, 348 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30617 - DNA, 428 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaagcgcgtaccctgcgagacaccgcccttcactgttgcgcgtaaccaccacacccgccagcgccctagcgcccgctcctttcgctttcttcccttcctttctcgccacgttcgagaactcaagaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30618 - DNA, 316 bp, Artificial
  Mutation in BnaA.FAD2.a introduced by TALE nuclease pair BnFAD2_T03
cagccatgggtgcaggtggcagaatgcaagtgtctcctccctccaagaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30619 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30620 - DNA, 350 bp, Artificial
  Mutation in BnaA.FAD2.a introduced by TALE nuclease pair BnFAD2_T03
caggatccatgggtgcaggtggaataatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30621 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgttccctcgctctttctcctacctcatctgggacatcatcatagcctcctgcttctactacgtcgccaccgcttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 30622 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30623 - DNA, 412 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttcaggagagcgttcaccgacaaacaacagataaaacgaaaggcccagtcttccgactgagccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30624 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccatcacgccttcagcgactac

SEQ ID NO: 30625 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcacttcactgactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30626 - DNA, 354 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgattgtagaactcaagaaagcaatcccaccgcactgtttcaaacgctcgatccctcgctctttctcctacctcatctgggacatcatcatagcctcctgcttctactacgtcgccaccacctacttccctctcctccctcaccctctctcctacctcgcctggcctctctactgggcctgccagggctgcgtcctaaccggcgtctgggtcatagcccacgagtgcggccaccacgccttcagcgactac

SEQ ID NO: 30627 - DNA, 436 bp, Artificial
  Mutation in BnaA.FAD2.a introduced by TALE nuclease pair BnFAD2_T03
caggatccatgggtgcaggtgcaagaatgcaagtgtctcctccctccaaaaagtctgaaaccgacaacatcaagcgcgtaccctgcgagacaccgcccttcactgtaccccggagcaggtggtggccatcgccagcaatattggtggcaagcaggcgctggagacggtgcaggtggtggggtcaagccgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30628 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaacccaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgggcctgccaagggtgcgtcctaacgggcgtctgggtcatagcccacgagtgcggccaccacgccttcagcgactac

SEQ ID NO: 30629 - DNA, 295 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30630 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30631 - DNA, 409 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaggcaattcttcatctaatctaatattgattgaatgtctgagcattccgacactttcatgagaactcaagaaagcaatcccaccgcactgtttcaaacgctcgatccctcgctctttctcctacctcatctgggacatcatcatagcctcctgcttctactacgtcgccaccacttccttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 30632 - DNA, 323 bp, Artificial
  Mutation in BnaA.FAD2.a introduced by TALE nuclease pair BnFAD2_T03
caggatccatgggtgcaggtggaagaatgcaagtgtctcctccctccaagaagtctgaacccgacaccatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30633 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctgacccctctactgggcctgccaaggctgcgtcctaacgggcgtctgggtcatagcccacgagtgcggccaccacgccttcagcgactac

SEQ ID NO: 30634 - DNA, 350 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaaacgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 30635 - DNA, 394 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgccggtgctgtgccaggcccacggcttgaccccccagcaggtggtgggaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 30636 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaactgacaccatcaagcgcgtaccctgcgagacaccgcccttcactgttagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30637 - DNA, 323 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 30638 - DNA, 357 bp, Artificial
  Mutation in BnaA.FAD2.a introduced by TALE nuclease pair BnFAD2_T03
caggatccatgggtgcaggtggaagaatgcaagtgtctcctccctcaaagaagtctgaaaccgacaccatcaagcgcgtaccctgcgcgacaccgcccttcactgtttttgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30639 - DNA, 349 bp, Artificial
  Mutation in BnaA.FAD2.a introduced by TALE nuclease pair BnFAD2_T03
caggatccatgggtgcagggggaagaatgcaagtgtgtcgtctcacaaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacctcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgccatcagcgactac

SEQ ID NO: 30640 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttatttccctctcctccctcaccctctctcctacttcgcctggcctctctactgggccggccagggctgcgtcctaaccggcgtctgggtcatagcccacgagtgcggccaccacgccttcatcgactac

SEQ ID NO: 30641 - DNA, 334 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctacggggcctgccaaggctgcgtcctaacgggcctctgggtcataggccacgagtgcggccaccacgccttcagcgactac

SEQ ID NO: 30642 - DNA, 378 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggctgttgccggtgctgtgccaggcccagaactcaagaaagcaatcccaccgcactgtttcaaacgctcgatccctcgctctttctcctacctcatctgggacatcatcatagcctcctgcttctactacgtcgacaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30643 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30644 - DNA, 328 bp, Artificial
  Mutation in BnaA.FAD2.a introduced by TALE nuclease pair BnFAD2_T03
caggatccatggggcaggtggaagaatgcaagtgtctcctccctccaaaaagtctgaaaccgacaacatcaagcgcgtaccctgcgagacaccgcacgtcatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 30645 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 30646 - DNA, 349 bp, Artificial
  Mutation in BnaA.FAD2.a introduced by TALE nuclease pair BnFAD2_T03
caggatccatgggtgcaggtggaagaatgcaagtgtctactcactccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctagcctctctacggggcctgccagggctgcggcctaaccggcgtcggggtcatagcccacgagtgcggccaccgcgccttcagcgactac

SEQ ID NO: 30647 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30648 - DNA, 411 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcctggcacagcaccggcaacagccgctggaccgtctccagcgcctgcttgccaccattagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30649 - DNA, 350 bp, Artificial
  Mutation in BnaA.FAD2.a introduced by TALE nuclease pair BnFAD2_T03
caggatccatgggtgcaggtggaagaatgcaagtctctcctcactccagctcccccggaaccaacaccctcaaacgcgtcccctgcgagacaccaccattcactcgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30650 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacgacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30651 - DNA, 350 bp, Artificial
  Mutation in BnaA.FAD2.a introduced by TALE nuclease pair BnFAD2_T03
caggatccatgggtgcaggtgaaagaatgcaagtgtctcctccctaaaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 30652 - DNA, 348 bp, Artificial
  Mutation in BnaA.FAD2.a introduced by TALE nuclease pair BnFAD2_T03
caggatccatgggtgcaggtggaagaatgcaagtgtctactccctacaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaaccggcgtctgggtcatagcccacgagggcggccaccacgccttcagcgactac

SEQ ID NO: 30653 - DNA, 357 bp, Artificial
  Mutation in BnaA.FAD2.a introduced by TALE nuclease pair BnFAD2_T03
caggatccatgggtgcaggtgcaagaatgcaagtgtctcctccctccaaaaagtctgaaaccgacaacatcaagcgcgtaccctgcgagacaccgcccttcactgtcggtcggagaactcaagaaagcaatcccacctcactgcttcaaacgctccatcccacgctccttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 30654 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccatcaaacgcgtcccctgcgagacaccgcccttcactgagaactcaagaaagcaatcccaccgcactgtttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30655 - DNA, 280 bp, Artificial
  Mutation in BnaA.FAD2.a introduced by TALE nuclease pair BnFAD2_T03
caggatccatgggtgcaggtggaagaatgcaagtctcgacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30656 - DNA, 350 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30657 - DNA, 443 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcactgccaggcgtcaaactaagcagaaggccatccgtcaccagcggctgttgccggtgctgtgccaggcccacggcttgaccccggagcaggtggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30658 - DNA, 319 bp, Artificial
  Mutation in BnaA.FAD2.a introduced by TALE nuclease pair BnFAD2_T03
caggatccatgcgtgcaggtggaagaatgcaagtctctcctccctccagctcccccggaaccaacaccctcaaacgcgtcccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30659 - DNA, 337 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaaacgcgtcccctgcgagacaccaccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30660 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtccgggtcatagcccacgagtgcggccaccacgccttcagcgactac

SEQ ID NO: 30661 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtttcaaacgctcgatccctcgctctttctcctacctcatctgggacatcatcatagactactgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30662 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaacccgacaacatcaagcgcgtaccctgcgagacaccgcccttcactgtagaactcaagaaagcaatcccaccgcactgtttcaaacgctcgatccctcgctctttctcctacctcatctgggacatcgtcatagcctcctgcttctactacgtcgccaccacttacttccctctcctccctcaccctctctcctactacgcctggcctctctactgggcctgccagggctgcgtcctaaccggcgtctggtttatagcccacgagtgctgccacgacgccttcagcgactac

SEQ ID NO: 30663 - DNA, 348 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtaactcaagaaagcaatcccaccgcactgtttcaaacgctcgatccctcgctctttctactacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30664 - DNA, 326 bp, Artificial
  Mutation in BnaA.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30665 - DNA, 305 bp, Artificial
  Mutation in BnaA.FAD2.a introduced by TALE nuclease pair BnFAD2_T03
caggatccatgggtgcaggtgaaagaatgcaagtgtctcctccctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccacgccttcagcgactac

SEQ ID NO: 30666 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagccgcctgcttctactacgtcgccaccacttacttccctctcctccctcaccctctctcctacttcgcctggcctctctactgggcctgcccgggctgcgtcctaaccggcgtctgggtcatagcccacgagtgcggccaccacgccttcagcgactac

SEQ ID NO: 30667 - DNA, 422 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggcaagcaggcgctggagacggtccagcggctgttgccggtgctgtgccaggcccacggcttgaccacggcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30668 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30669 - DNA, 411 bp, Artificial
  Mutation in BnaA.FAD2.a introduced by TALE nuclease pair BnFAD2_T03
caggatccatgggtgcaggtggaagaatgcaagtgtctcctcactacaaaaagtctgaaaccgacaacatcaagcgcgtaccctgcgagacaccgcccttcactgtcggcctggcacagcaccggcaacagccgctggaccgtctccagcgcctgcttgccaccattagaactcaagaaagcaatcccaccgcactgtttcaaacgctcgatccctcgctctttctcctacctcatctgggacatcatcatagcctcctgcttctactacgtcgccaccacttacttcactctcctccctcaccctctctcctacttcgcctggcctctctactgggcctgccagggctgcgtcctaaccggcgtctgggtcatagcccacgagtgcggccaccacgccttcagcgactac

SEQ ID NO: 30670 - DNA, 352 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcacttcactgtcgagaactcaagaaagcaatcccaccgcactgtttcaaaagctcgatccctcgctctttctcctacctcatctgggacatcatcatagcctcctgctcctactacgtcgccaccacttacttccctctcctccctcaccctctctcctacttcgcctggcctctctactgggcctgccaagggtgcgtcctaacgggcctctgggtcatctcccacgaatgcggccaccacgccttcagcgactac

SEQ ID NO: 30671 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30672 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggcctctctactgggcctgccagggctgcgtcctaaccggcgtctgggtcatagcccacgagtgcggccaccacgccttcagcgactac

SEQ ID NO: 30673 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgtcaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30674 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccatggctgcgtcctaacgggcgtctgggtcatagcccacgagtgcggccaccacgccttcagcgactac

SEQ ID NO: 30675 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcggagaactcaagaaagcaatcccaccgcactgtttcaaacgctcgatccctcgctctttctcctgcctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30676 - DNA, 351 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30677 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30678 - DNA, 443 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactctcagcggcggcggaactctttgatccggttcctgaacaggctctatttgaggcgctaaatgacaccttaacgctatggaactcgccgcccgactggacctcaagaaagcaatcccacctcactgcttcaaacgctcgatccctcgctctttctcctacctcatctgggacatcatcatagcctcctgcgtctactacgtcgccaccacttacttccctctccgccctcaccctctctcctacttcgcctggcctctctactgggcctgccagggctgcgtcctaaccggcgtcttggtcatagcccacgagtgcggccaccacgccgtcagcgactac

SEQ ID NO: 30679 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaacgggcctcttggtcatcgcccacgaatgcggccaccacgccttcagcgactac

SEQ ID NO: 30680 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgacggagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30681 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtacccccagcaggtggtgaccatcgccagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 30682 - DNA, 319 bp, Artificial
  Mutation in BnaA.FAD2.a introduced by TALE nuclease pair BnFAD2_T03
caggatccatgggtgcaggcgcaagaatgcaagtgtcccctccctacaagaagtctgaaaccgacaacaacaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30683 - DNA, 347 bp, Artificial
  Mutation in BnaA.FAD2.a introduced by TALE nuclease pair BnFAD2_T03
caggatccatgggtgcaggtgcaagaatgcaagtgtcccctcactcgaaaaagtctgaacccgacaacatcaagcgcgtaccctgcgagacaccgcccttcaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 30684 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcacagacctcaagaaagcaatcccaccgcactgtctcaaacgctctatctcccgctctttctcctacctcacctgggacatcatcatagcctcctgcttctactacgtcgccaccacttacatccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30685 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctcccctcccccaccctctctcctacttcgcctggcctctctactgggcctgccaagggtgcgtcctaacgggcgtctgggtcatagcccacgagtgcggccaccacgccttcagcgactac

SEQ ID NO: 30686 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 30687 - DNA, 327 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30688 - DNA, 373 bp, Artificial
  Mutation in BnaA.FAD2.a introduced by TALE nuclease pair BnFAD2_T03
caggatccatgggtgcaggtggaagaatgcaagtgtctagtcagtccaaaaagtctgaaaccgacaacatcaagcgcgtaccctgcgagacactgccaggcatcaaactaagcagaaggccatccgtcaaacgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctggcctctctactgggtctgccagggcggcgtcctaaccggcgtctgggtcatagcccacgagtgcggccaccacgccttcagcgactac

SEQ ID NO: 30689 - DNA, 398 bp, Artificial
  Mutation in BnaA.FAD2.a introduced by TALE nuclease pair BnFAD2_T03
caggatccatggggtgcaggtggaagaatgcaagtgtctcctccctccaaaaagtctgacaccgacaacatcaagcgcgtaccctgcgagacaccgcccttcactgagcaggtggtggccatcgccagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30690 - DNA, 342 bp, Artificial
  Mutation in BnaA.FAD2.a introduced by TALE nuclease pair BnFAD2_T03
caggatccatgggtgcaggtgaaagaatgcaagtgtcacctccctccaagaagtctgaaaccgacaccatcaagcgcgtacccagcgagacaccgcccttaactcaagaaagcaatcccaccgcactgattcaaacgctcgatccctcgctctttctcctacctcatctagcacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30691 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgattgcggccaccacgccttcagcgactac

SEQ ID NO: 30692 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcccgtaccctgcgagacaccgcccttcactgtcgtctccagcgcctgcttgccgccatcgtggctggcgatggccaccacctgctccggactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgagtgcggccaccacgccttcagcgactac

SEQ ID NO: 30693 - DNA, 437 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcgcctgcttgccaccattattgctggcgatggccaccacctgctggggggtcaagttgagcggggcacccgtcagtgcatgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30694 - DNA, 347 bp, Artificial
  Mutation in BnaA.FAD2.a introduced by TALE nuclease pair BnFAD2_T03
caggatccatgggtgcaggcggaagaatgcaagtgtctactccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcttggtcatagcccacgagtgcggccaccacgccttcagcgactac

SEQ ID NO: 30695 - DNA, 348 bp, Artificial
  Mutation in BnaA.FAD2.a introduced by TALE nuclease pair BnFAD2_T03
caggatccatgggtgcagggggaagaatgcaagtgtctactccctccaaaaagtctgaaaccgacaacatcaagcgcgtaccctgcgagacaccgcccttcacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30696 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30697 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30698 - DNA, 327 bp, Artificial
  Mutation in BnaA.FAD2.a introduced by TALE nuclease pair BnFAD2_T03
caggatccatgggtgcaggtggaagaatgcaagtgtctcctcaatacaaaaagtctgaaaccgacaacatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctctccctctctcctacttcgcctggcctctctactgggcctgcctagggtgcgtcctaaccggcgtctgggtcatatcccacgagtgcgtcctccacgccagcaacgactac

SEQ ID NO: 30699 - DNA, 331 bp, Artificial
  Mutation in BnaA.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacctcaagaaagcaatcccaccgcactgattcaaacgctcgatcccacgctctttctcctacctcatctgggacatcatcatatcctcctgcttctactacgtcgccaccacttacttccctctcctccctcaccctctctcctacttcgcctggcctctctactgggcctgccagggctgcgtcctaaccggcgtctgggtcatagcccacgagggcggccaccacgccttcagcgactac

SEQ ID NO: 30700 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagtccacgagtgcggccaccacgccttcagcgactac

SEQ ID NO: 30701 - DNA, 324 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 30702 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcaagggtgcgtcctaaccggcgtctgggtcatagcccacgagtgcggccaccacgccttcagcgactac

SEQ ID NO: 30703 - DNA, 337 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30704 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 30705 - DNA, 428 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacgcgtacccataaccgctcaacttgaccccccagcaggtggtggccatcgccagcaataatggtggcaagcaggcgctggagagaactcaagaaagcaatcccaccgcactgtttcaaacgctcgatccctcgctctttctcctacctcatctgggacatcatcatagcctcctgcttctactacgtcgccacctcttacgtccctctcctccctccccctctctcctacttcgcctggcctctctactgggccggccagggctgcggcctaaccggcgtctgggtcatagcccacgagtgcggccaccacgccttcagcgactac

SEQ ID NO: 30706 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcgtctgggtcatagcccacgagtgcggccaccacgccttcagcgactac

SEQ ID NO: 30707 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30708 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagaactcaagaaagcaatcccaccgcactgtttcaaacgctcgatccctcgcgctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 30709 - DNA, 317 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctggcaagggtgcgtcctaaccggcgtctgggtcatagcccacgagtgcggccaccacgccttcagcgactac

SEQ ID NO: 30710 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcgggcctggcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgctaagggtgcgtcctaaccggcgtctgggtcatagcccacgagtgcggccaccacgccttcagcgactac

SEQ ID NO: 30711 - DNA, 413 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgttgccgctggaccgtctccagcgcctgcttgccaccattattgctggcgatggccactacctgcttaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30712 - DNA, 421 bp, Artificial
  Mutation in BnaA.FAD2.a introduced by TALE nuclease pair BnFAD2_T03
caggatccatgggtgcaggtggaagaatgcaagtgtctcctccctcaaaaaagtctgaaaccgacaacatcaagcgcgtaccctgcgagacaccgcccttcactatttgatgcctggcagttccctactctcgccagcaataatggtggcaagcaggcgctggagacggtccagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30713 - DNA, 425 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagttcggttcgttcgacagtggcgcagcaccacgaggcactggtcggccacgggtttacacacgcgcacaagaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30714 - DNA, 318 bp, Artificial
  Mutation in BnaA.FAD2.a introduced by TALE nuclease pair BnFAD2_T03
caggatccatgggtgcaggtgaaagaatgcaagtgtctactcactacaaaaagtctgagaccgacaacatcaagcgcgtaccctgcgagacaccgccctcactgtttcaaacgctcgatccctcgctctttctcctacctcatctgggacatcatcatagcctcctgcttctactacgtcgccaccacttacttccatctcctccctcaccctctctcctacttcgcctggcctctctactgggcctgccaagggtgcgtcctaaccggcgtctgggtaatagcccacgagtgcggcctccacgccttcagcgactac

SEQ ID NO: 30715 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30716 - DNA, 349 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30717 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30718 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30719 - DNA, 402 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30720 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 30721 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 30722 - DNA, 317 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgtcctccacgccttcagcgactac

SEQ ID NO: 30723 - DNA, 351 bp, Artificial
  Mutation in BnaA.FAD2.a introduced by TALE nuclease pair BnFAD2_T03
caggatccatgggtgcaggtggaagaatgcaagtgtctcatacctacaaaaagtctgaaaccgacaacatcaagcgcgtaccctgcgagacaccgcccatcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtccgaaccggcgtctgggtgatagcccacgagtgcggccaccacgccttcagcgactac

SEQ ID NO: 30724 - DNA, 402 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatatcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30725 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccataaagcgcgtaccctgcgagcaaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctcacccaccctctcccttacctcgcctggcccctctactgggccttccaaggctgcgtcctaacgggcctctgggtcatcgcccacgaatgcgtccaccacgccttcagcgactac

SEQ ID NO: 30726 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctggcctctctactgggcctgccagggctgcgtcctaaccggcgtctgggtcatagcccacgagtgcggccaccacgccttcagcgactac

SEQ ID NO: 30727 - DNA, 350 bp, Artificial
  Mutation in BnaA.FAD2.a introduced by TALE nuclease pair BnFAD2_T03
caggatccatgggtgcaggtgcaagaatgcaagtgtctcctccctccaaaaagtctgaacccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30728 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 30729 - DNA, 349 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 30730 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30731 - DNA, 342 bp, Artificial
  Mutation in BnaA.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 30732 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccgtcagcgactac

SEQ ID NO: 30733 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctatcctccctcaccctctctcctacttcgcctggcctctctactgggcctgccagggctgcgtcctaaccggcgtctgggtcatagcccacgagtgcggccaccacgccttcagcgactac

SEQ ID NO: 30734 - DNA, 347 bp, Artificial
  Mutation in BnaA.FAD2.a introduced by TALE nuclease pair BnFAD2_T03
caggatccatgggtgcaggtgcaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacaagtgcggccaccacgcctgcagcgactac

SEQ ID NO: 30735 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccagggctgcgtcctaaccggcgtctgggtcatagcccacgagggcggccaccacgccttcagcgactac

SEQ ID NO: 30736 - DNA, 350 bp, Artificial
  Mutation in BnaA.FAD2.a introduced by TALE nuclease pair BnFAD2_T03
aaggatccatgggtgcaggtggaagaatgcaagtgtctcctcactccaaaaagtctgaaaccgacaacatcaagcgcgtaccctgcgagacaccgcccttcactgtagaactcaagaaagcaatcccaccgcacggtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30737 - DNA, 351 bp, Artificial
  Mutation in BnaA.FAD2.a introduced by TALE nuclease pair BnFAD2_T03
caggatccatgggtgcaggtgcaagaatgcaagtgactcctccctcaaaaaagtctgaaaccgacaacatcaaacgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 30738 - DNA, 348 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30739 - DNA, 411 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggcctggcacagcaccggcaacagccgctggaccgtctccagcgcctgcttgccaccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30740 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaggtcggagaactcaagaaagcaatcccaccacactgtttcaaacgctcggtccctcgctctttctcctacctcatctaggacatcctcatagcctcctgcttctactacgtctccaccacttacctccctctcctccctctccctctctcctacttcgcctggcccctctactgggcctgccaagggtgcgtcctaaccggcgtctgtgtcatagcccacgagtgcggccaccacgccttcagcgactac

SEQ ID NO: 30741 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcagagcccacgagtgcggccaccacgccttcagcgactac

SEQ ID NO: 30742 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaactgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 30743 - DNA, 342 bp, Artificial
  Mutation in BnaA.FAD2.a introduced by TALE nuclease pair BnFAD2_T03
caggatccatgggtgcaggtggaagaatgcaagtgtctcctccctacaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 30744 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcacctcaagaaagcaatcccacctcactgcttcaaacgctccatccctcgctccttctcctacctcatctgggacatcatcatagcctcctgcttctactacgtcgccaccacttacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 30745 - DNA, 350 bp, Artificial
  Mutation in BnaA.FAD2.a introduced by TALE nuclease pair BnFAD2_T03
caggatccatgggtgcagggggaagaatgcaagtgtctacttcctccaaaaagtctgaaaccgacaacatcaagcgcgtaccctgcgagacaccgcccttcactgtagaactcaagaaagcaatcccaccgcactgtttcaaacgcacgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30746 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcgcgactac

SEQ ID NO: 30747 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30748 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctccgccctcaccctctctcctacttcgcctggcctctctactgggcctgccagggctgcgtcctaaccggcgtctgggtcatagcccacgagtgcggccaccacgccttcagcgactac

SEQ ID NO: 30749 - DNA, 351 bp, Artificial
  Mutation in BnaA.FAD2.a introduced by TALE nuclease pair BnFAD2_T03
caggatccatgggtgcagggggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacgtcatcatagcctcctgcttctactacgtcgccaccacttacttccctctcctccctccccctctctcctacttcgcctggcctctctactgggcctgccagggctgcgtcctaaccggcggctgggtcatagcccacgagtgcggccaccacgccttcagcgactac

SEQ ID NO: 30750 - DNA, 349 bp, Artificial
  Mutation in BnaA.FAD2.a introduced by TALE nuclease pair BnFAD2_T03
caggatccatggggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30751 - DNA, 396 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggttcctggccttttgctggccttttgctcacatgttctttccgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30752 - DNA, 351 bp, Artificial
  Mutation in BnaA.FAD2.a introduced by TALE nuclease pair BnFAD2_T03
caggatccatgggtgcaggtggaagaatgcaagtgtctcctccctacaaaaagtctgaacccgacaccatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30753 - DNA, 337 bp, Artificial
  Mutation in BnaA.FAD2.a introduced by TALE nuclease pair BnFAD2_T03
caggatccatgggtgcaggtgcaagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcgcgactac

SEQ ID NO: 30754 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctccactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30755 - DNA, 345 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30756 - DNA, 349 bp, Artificial
  Mutation in BnaA.FAD2.a introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30757 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtttcaaacgctcgatccctcgctctttctcctacctcatctgggacatcatcatagcctcccgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30758 - DNA, 351 bp, Artificial
  Mutation in BnaA.FAD2.a introduced by TALE nuclease pair BnFAD2_T03
caggatccatgggtgcaggttgaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30759 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcgtctgggtcatagcccacgagtgcggccaccacgccttcagcgactac

SEQ ID NO: 30760 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcacgactac

SEQ ID NO: 30761 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccattcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30762 - DNA, 423 bp, Artificial
  Mutation in BnaA.FAD2.a introduced by TALE nuclease pair BnFAD2_T03
caggatccatgggtgcaggtggaagaatgcaagtctctcctcactacagctcccccgaaaccaaaaccctccaacgcgtcccctgcgagacaccacccttcactctcgacttcgctgctacccaaggttgccccacgagtacatcgagctgatcgagatcgcccggaacagcacccaagagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgtgtcctaaccggcgtctgggtcttagcccacgagtgcggccaccacgccttcagcgactac

SEQ ID NO: 30763 - DNA, 347 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 30764 - DNA, 378 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 30765 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgccgggcctctctactgggcctgccaggctgcgtcctaaccggcgtctgggtcatagcccacgagtgcggccaccacgccttcagcgactac

SEQ ID NO: 30766 - DNA, 308 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30767 - DNA, 336 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30768 - DNA, 373 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacactgccaggcatcaaactaagcagaaggccatccgtcaaacgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30769 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30770 - DNA, 346 bp, Artificial
  Mutation in BnaA.FAD2.a introduced by TALE nuclease pair BnFAD2_T03
caggatccatgggtgcaggtggaagaatgcaagtgtctcatccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcttcctaaccggcgtctgggtcatagcccacgagtgcggccaccacgccaacaacgactac

SEQ ID NO: 30771 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctatcctacttcgcctggcctctctactgggcctgccagggctgcgtcctaaccggcgtctgggtcatagcccacgagtgcggccaccacgccttcagcgactac

SEQ ID NO: 30772 - DNA, 349 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30773 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 30774 - DNA, 337 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaccatcaagcgcgtaccctgcgagacaccgcccttcactgtgagaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 30775 - DNA, 339 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgaaagcaatcccaccgcactgtttcaaacgctcgatccctcgctctttctcctacctcatctggggcatcatcatagcctcctgcttctactacgtcgccaccacttacttccctctcctccctcaccctctctcctacttcgcctggcctctctactgggcctgccaagggtgcgtcctaacgggcgtctgggtcatagcccacgagtgcggccaccacgccttcagcgactac

SEQ ID NO: 30776 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctatcctccctcaccctctctcctacttcgcctggcctctctactgggcctgccagggctgcgtcctaacgggcctctgggtcatcgcccacgaatgcggccaccacgccttcagcgactac

SEQ ID NO: 30777 - DNA, 349 bp, Artificial
  Mutation in BnaA.FAD2.a introduced by TALE nuclease pair BnFAD2_T03
caggatccatgggtgcaggtgaaagaatgcaagtctctactccctccagctcccccggaaccaacaccctcaaacgcgtcccctgcgagacaccaccattcactgagacctcaagaaagcaatcccaccgcactgtttcaaacgcttgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30778 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagaccacgagtgcggccaccacgccttcagcgactac

SEQ ID NO: 30779 - DNA, 450 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgagcgatcgttggcgtcggcaaacagtggtccggcgcacgcgctctggaggccttgctcacggtggcgggagagttgagaggtccaccgttacagttggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctcctggcctctctactgggcctgccagggctgcgtcctaaccggcgtctgggtcatagcccacgagtgcggccaccacgccttcagcgactac

SEQ ID NO: 30780 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcagccaccacgccttcagcgactac

SEQ ID NO: 30781 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccattcactgtaagaactcaagaaagcaatcccaccgcactgtttcaaacgctcgatccctcgctctttctcctacctcatctgggacctcatcatagcctcctgcttctactacgtcgccaccacttacttccctctcctcccacaccctctctcctacttcgcctggcctctctactgggcctgccagggctgcgtcctaaccggcgtctgggtcatagcccacgagtgcggccaccacgccttcagcgactac

SEQ ID NO: 30782 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctctttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 30783 - DNA, 349 bp, Artificial
  Mutation in BnaA.FAD2.a introduced by TALE nuclease pair BnFAD2_T03
caggatccatgggtgcaggaggaagaatgcaagtctctcctccctacagctcccccgaaaccaaaaccctcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30784 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacactcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30785 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcccctctactgggcctgccaaggctgcgtcctaacgggcctctgggtcatcgcccacgaatgcggccaccacgccttcatcgactac

SEQ ID NO: 30786 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcaactac

SEQ ID NO: 30787 - DNA, 359 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggatcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 30788 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctccatccctcgctctttctcctacctcatctgggacatcctcatcgcctcctgcttctactacgtcgccaccgcctacttccctctcctccctcaccctctctcctacttcgcctggcccctctactgggcctgccagggctgcgtcctaacgggcctctgggtcatagcccacgagtgcggccaccacgccttcagcgactac

SEQ ID NO: 30789 - DNA, 280 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaggactgcgtcctaaccggcgtctgggtcatagcccacgagtgcggccaccacgccttcagcgactac

SEQ ID NO: 30790 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaccatcaagcgcgtcccctgcgagacaccgcccttcacaagaactcaagaaagcaatcccaccccactgcttcaaacgccccatccctccctctttctcctacctcacctggggcatcatcatagcctcctgcttctactacgtcgccaccccttacctccctctcctccctcaccctctcccctacttcccctggcccctctactggggctgccaaggctgcggcctaacgggcctctgggtcatagcccacgagtggggcccccacgccctcagcgactacc

SEQ ID NO: 30791 - DNA, 392 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgtaatctggaacatcgtatgggtaatcgatgaccttacgtttaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30792 - DNA, 350 bp, Artificial
  Mutation in BnaA.FAD2.a introduced by TALE nuclease pair BnFAD2_T03
caggatccatgggtgcaggtggaagaatgcaagtggctactgactacaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcttcctaaccggcgtctgagtcacagcccacaagtgcggcctccacgccttcaacgactac

SEQ ID NO: 30793 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 30794 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30795 - DNA, 373 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcacattaaccagctgcattaatgaatcggccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaatgctgcgtcctaaccggcgtctgggtcatagcccacgagtgcggccaccacgccttcagcgactac

SEQ ID NO: 30796 - DNA, 351 bp, Artificial
  Mutation in BnaA.FAD2.a introduced by TALE nuclease pair BnFAD2_T03
caggatccatgggtgcaggtggaagaatgcaagtgtcacctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactac

SEQ ID NO: 30797 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcaactgggacatcatcatcgcctcctgcttctactacgtcgccaccgcctacttccctctcctccctcaccctctctcctacctcgcctggcctctctactgggcctgccagggctgcgtcctaaccggcgtctgggtcatagcccacgagtgcggccaccacgccttcagcgactac

SEQ ID NO: 30798 - DNA, 350 bp, Artificial
  Mutation in BnaA.FAD2.a introduced by TALE nuclease pair BnFAD2_T03
caggatccatgggtgcaggtgaaagaatgcaagtgtctactcactccaaaaagtctgaaaccgacaacatccagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggcggcgtccgaaccggcgtctgggtcagagcccgcgagtgcggccaccacgccggcagcgactac

SEQ ID NO: 30799 - DNA, 376 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgctgcgtaacatcgttgctgctccagagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30800 - DNA, 349 bp, Artificial
  Mutation in BnaA.FAD2.a introduced by TALE nuclease pair BnFAD2_T03
caggatccatgggtgcaggtggaagaatgcaagtctctcctcacttcagctcccccgaaaccaaaaccctcaaacgcgtcccctgcgagacaccacccttcactcagacctaaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgcctac

SEQ ID NO: 30801 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 30802 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30803 - DNA, 351 bp, Artificial
  Mutation in BnaA.FAD2.a introduced by TALE nuclease pair BnFAD2_T03
caggatccatgggtgcaggtggaagaatgcaagtgtctccaccctccaaaaagtctgaaaccgacaacatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30804 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtacactgcgagacaccgcccttcataagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30805 - DNA, 349 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 30806 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30807 - DNA, 332 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctgcgagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30808 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30809 - DNA, 360 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgtcgcgacgcgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccgtcgtctgggtcatagcccacgagtgcggccaccacgccttcagcgactac

SEQ ID NO: 30810 - DNA, 406 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgccgtcgggcttcctggagccgcccgatttagagcttgacggggaaagccggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30811 - DNA, 351 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaaccggcgtctgggtcatagcccacgagtgcggccaccacgccttcagcgactac

SEQ ID NO: 30812 - DNA, 404 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggacctgccagggctgcgtcctaaccggcgtctgggtcatagcccacgagtgcggccaccacgccttcagcgactac

SEQ ID NO: 30813 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgcctgcagcgactac

SEQ ID NO: 30814 - DNA, 312 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtcccctgcgagacaccacccttcactcaacctcaagaaagcaatcccacctcactgcttcaaacgctccatcccacgctccttctcctcttcgacatcatcatctcctcctcggctcctccctcaccctctctcctacttcgcctggcctctctactgggcctgccagggctgcgtcctaaccggcgtctgggtcatagcccacgagtgcggccaccacgccttcagcgactac

SEQ ID NO: 30815 - DNA, 305 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30816 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggcggcggcctaaccggcgtctgggtcatagcccacgagtgcggccaccacgcctgcagcgactac

SEQ ID NO: 30817 - DNA, 357 bp, Artificial
  Mutation in BnaA.FAD2.a introduced by TALE nuclease pair BnFAD2_T03
caggatccatgggtgcaggtggaagaatgcaagtgtatacacactccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30818 - DNA, 350 bp, Artificial
  Mutation in BnaA.FAD2.a introduced by TALE nuclease pair BnFAD2_T03
caggatccatgggtgcaggtggaagaatgcaagtgtctcctcactacaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgtgtgcgtccaccacgcctgcagcgactac

SEQ ID NO: 30819 - DNA, 350 bp, Artificial
  Mutation in BnaA.FAD2.a introduced by TALE nuclease pair BnFAD2_T03
caggatccatgggtgcaggtggaagaatgcaagtttctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 30820 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtacccccagcaggtggtgaccatcgccagaactcaagaaaacaatcccaccgcactgtttcaaacgctcgatccctcgctctttctcctacctcttctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30821 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccccctcactgcttcaaacgctccatccctcgctctttctcctacctcatcttggacatcatcatagcctcctgcttctactacctcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30822 - DNA, 349 bp, Artificial
  Mutation in BnaA.FAD2.a introduced by TALE nuclease pair BnFAD2_T03
caggatccatgggtgcaggcgcaagaatgcaagtgtctactccctcaaaaagtctgaaaccgacaaccacaaacccgtacccttccaaaccccccccttcacttgacaacgacagaaagcaatcccaccgcactgtttccaacgctcgattcctcgctctttctcctacctcatctacgacatcatcatatcctcctgcttctactacgccacccccacctacttccctctcctctctctccctctcccctacctcgcctggcctctctactgggcctgccaagggtgcgtcctaaccggcgtctgggtcatagcccacgagtgcggccaccacgccttcagcgactac

SEQ ID NO: 30823 - DNA, 331 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagttcggccaccacgccttcagcgactac

SEQ ID NO: 30824 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30825 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacttcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30826 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcggcctaaccggcgtctgggtcatagcccacgagtgcggccaccacgcctgcagcgactac

SEQ ID NO: 30827 - DNA, 331 bp, Artificial
  Mutation in BnaA.FAD2.a introduced by TALE nuclease pair BnFAD2_T03
caggatccatgggtgcaggtggaagaatgcaagtgtctactgcctacaaaaagtctgaaaccgacaacatcaaacgcgtaccctgcgagaactcaagaaagcaatcccaccgcactgtttcaaacgctcgatccctcgctctttcacctacctcatctgggacaacatcatagcctcctgcttctactacgtcgccaccacttacttccctctcctccctcaccctctctcctacttcccctggcctctctactgggcctgccaagggtgcgtcctaaccggcgtctgggtcatagcccacgagtgcgtccaccacgccttcagcgactac

SEQ ID NO: 30828 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccacagcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30829 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccaccgcactgtttcaaacgctcgatccctcgctctttctcctaccacatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30830 - DNA, 342 bp, Artificial
  Mutation in BnaA.FAD2.a introduced by TALE nuclease pair BnFAD2_T03
caggatccatgggtgcaggtggaagaatgcaagtgtctcctcactccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcgtccaccacgccttcagcgactac

SEQ ID NO: 30831 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30832 - DNA, 389 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgatttcttgtcaaaaatgctccactgacgttccataaattcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30833 - DNA, 314 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcggcctaaccggcgtctgggtcatagcccacgagtgcggccaccacgccttcagcgactac

SEQ ID NO: 30834 - DNA, 306 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30835 - DNA, 342 bp, Artificial
  Mutation in BnaA.FAD2.a introduced by TALE nuclease pair BnFAD2_T03
caggatccatgggtgcaggtggaagaatgcaagtgtcccccccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30836 - DNA, 395 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccaacaccatcaagcgcgtaccctgcgagacaccgcccttcactgtacggatggccttctgcttagtttgatgcctggcagtttatggcgggcatactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgctac

SEQ ID NO: 30837 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaagaactcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 30838 - DNA, 343 bp, Artificial
  Mutation in BnaA.FAD2.a introduced by TALE nuclease pair BnFAD2_T03
caggatccatgggtgcaggtggaagaatgcaagtgtctcctcctccaaaaagtctgaaaccgacaccatcaagcgcgtaccctgcgagacaccgcccttcacactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 30839 - DNA, 428 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgttgcgcgtaaccaccacacccgccagcgccctagcgcccgctcctttcgctttcttcccttcctttctcgccacgttcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggtcctgccagggctgcgtcctaaccggcgtctgggtcatagcccacgagtgcggccaccacgcctgcggcgactac

SEQ ID NO: 30840 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggccatagcccacgagtgcggccaccacgccttcagcgactac

SEQ ID NO: 30841 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcgcgactac

SEQ ID NO: 30842 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgagaactcaagaaagcaatcccaccgcactgtttcaaacgctcgatcccacgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30843 - DNA, 350 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 30844 - DNA, 346 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30845 - DNA, 319 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaccatcaagcgcgtaccctgcgagacaccacccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30846 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttcccctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30847 - DNA, 287 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 30848 - DNA, 406 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcggagccgcttgccgccattgctggcgatggccaccacctgctggggggtcaagccgtgggtagaactcaagaaagcaatcccaccgcactgtttcaaacgctcgatccctcgctctttctcctacctcatctgggacatcatcatagcctcctccttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30849 - DNA, 343 bp, Artificial
  Mutation in BnaA.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccatggcggacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30850 - DNA, 356 bp, Artificial
  Mutation in BnaA.FAD2.a introduced by TALE nuclease pair BnFAD2_T03
caggatccatgggtgcaggtggaagaatgcaagtgtctccccccacaaagaagtctgaaaccgacaccaccaaccgcgtaccctgcgagacaccgcccttcacttcttccaccgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30851 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgcccgatccctcgctctttctcctacctcatctgggacatcatcatagcctcctgcttctactacgtcgccaccacttacttccctctcctccctcacactctctcctacttcgcctggcctctctactgggcctgccaagggtgcgtcctaaccggcgtctgggtcatagcccacgaatgcggccaccacgccttcagcgatac

SEQ ID NO: 30852 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccaccgcactgtttcaaacgctcgatccctcgctctttcgcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30853 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 30854 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30855 - DNA, 373 bp, Artificial
  Mutation in BnaA.FAD2.a introduced by TALE nuclease pair BnFAD2_T03
caggatccatgggtgcaggtggaagaatgcaagtgtctcctccctccaaaaagtatgaaaccgacaacatcaagcgcgtaccctgcgagacaccgcccttcacattaaccagctgcattaatgaatcggccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcattcagcgactac

SEQ ID NO: 30856 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccgcactgtttcaaacgctcgacccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30857 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaatggtgcgtcctaaccggcgtctgtgtcatagcccacgagtgcggccaccacgccttcagcgactac

SEQ ID NO: 30858 - DNA, 358 bp, Artificial
  Mutation in BnaA.FAD2.a introduced by TALE nuclease pair BnFAD2_T03
caggatccatgggtgcaggtggaagaatgcaagtctctcctccctccagctcccccggacccaacaccctcaaacccttcccctgcgggacaccaccattcactctcggcccggagacctcaagaaaccaatcccaccgcactgtttcaaacgctcgacccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30859 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgattcctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30860 - DNA, 393 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30861 - DNA, 351 bp, Artificial
  Mutation in BnaA.FAD2.a introduced by TALE nuclease pair BnFAD2_T03
caggatccatgggtgcaggtggaagaatgcaagtgtctacttcctccaaaaagtctgaaaccgacaccatcaagcgcgtaccctgcgagacaccgcccttcactttgagaactcaagaaagcaatcccaccgcactgtttcaaacgttcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 30862 - DNA, 452 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtggccatcgccagcaataatggtggcaggtggtggccatcgccagcaatggcggtggcaagcaggcgctggagacggtccagcggctgttgccggtgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30863 - DNA, 384 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagactgagcctttcgttttatctgttgcttgtcggccgacgctctcctgagtagatcaaatccgctctgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30864 - DNA, 350 bp, Artificial
  Mutation in BnaA.FAD2.a introduced by TALE nuclease pair BnFAD2_T03
caggatccatgggtgtaggtggaagaatgcaagtgtcacctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgagtgcggccaccacgccttcagcgactac

SEQ ID NO: 30865 - DNA, 459 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtatgcccgccaccctccgggccgttgcttcacaacgttcaaatccgctcccggcggatttgtcctactcaggagagcgttcaccctcagaaccgccaccctcagagccgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30866 - DNA, 349 bp, Artificial
  Mutation in BnaA.FAD2.a introduced by TALE nuclease pair BnFAD2_T03
caggatccatgggtgcaggtggaagaatgcaagtatctactccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30867 - DNA, 343 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctcggctcctccctctaccacctctccacagcctacttccctctcccttacctcgcctgacccctctactggtcctgccaaggctgcgtcctagcgggcctctgggtcatagcccacgagtgcggccaccacgcctgcagcgactac

SEQ ID NO: 30868 - DNA, 393 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30869 - DNA, 348 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30870 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtccgatctagaactcaagaaagcaatcccaccgcactgtttcaaacgctcgatccctcgctctttctcctacctcatctgggacatcatcatagcctcctgcttctactacctcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30871 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatccgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30872 - DNA, 346 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30873 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30874 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 30875 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcacacgagtgcggccaccacgccttcagcgactac

SEQ ID NO: 30876 - DNA, 350 bp, Artificial
  Mutation in BnaA.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcacgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30877 - DNA, 308 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcaacgactac

SEQ ID NO: 30878 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 30879 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30880 - DNA, 340 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 30881 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30882 - DNA, 351 bp, Artificial
  Mutation in BnaA.FAD2.a introduced by TALE nuclease pair BnFAD2_T03
caggatccatgggtgcaggtggaagaatgcaagtgtcacctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30883 - DNA, 381 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgaatgcatctagatccaatgatcatgagcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30884 - DNA, 323 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcggctac

SEQ ID NO: 30885 - DNA, 341 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgtgtaccctgcgagacaccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30886 - DNA, 351 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctacttcgcctggcctctctactgggcctgccagggctgcgtcctaaccggcgtctgggtcatagcccacgagtgcgtccaccacgccttcagcgactac

SEQ ID NO: 30887 - DNA, 294 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgatac

SEQ ID NO: 30888 - DNA, 350 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcggcctaaccggcgtctgggtcatagcccacgagtgcggccaccacgccttcagcgactac

SEQ ID NO: 30889 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacaattcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30890 - DNA, 428 bp, Artificial
  Mutation in BnaA.FAD2.a introduced by TALE nuclease pair BnFAD2_T03
caggatccatgggtgcaggtggaagaatgcaagtgtctcccccctccaaaaagtctgaaaccgacaacatcaagcgcgtaccctgcgagacaccgcccttcactgttgcgcgtaaccaccacacccgccagcgccctagcgcccgctcctttcgctttcttcccttcctttctcgccacgttcgagaactcaagaaagcaatcccaccgcactgtttcaaacgctcgacccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30891 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30892 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaaccggcgtctgggtcatagcccacgagtgcggccaccacgccttcagcgactac

SEQ ID NO: 30893 - DNA, 339 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 30894 - DNA, 359 bp, Artificial
  Mutation in BnaA.FAD2.a introduced by TALE nuclease pair BnFAD2_T03
caggatccatgggtgcaggtggaagaatgcaagtgtctcctccctccaaaaagtatgaaaccgacaacatcaagcgcgtaccctgcgagacaccgcccttcactgtcggatcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30895 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctgacccctctactgggcctgccaaggctgcgtcctaacgggcctctgggtcatagcccacgagtgcggccaccacgccttcagcgactac

SEQ ID NO: 30896 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccagggctgcgtcctaaccggcgtctgggtcatagcccacgagtgcggccaccacgccttcagcgactac

SEQ ID NO: 30897 - DNA, 345 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30898 - DNA, 349 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgagtgcggccaccacgccttcagcgactac

SEQ ID NO: 30899 - DNA, 349 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30900 - DNA, 354 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgctgccaccacgccttcagcgactac

SEQ ID NO: 30901 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgctaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30902 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgtggccaccacgccttcagcgactac

SEQ ID NO: 30903 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 30904 - DNA, 345 bp, Artificial
  Mutation in BnaA.FAD2.a introduced by TALE nuclease pair BnFAD2_T03
caggatccatgggtgcaggtggaagaatgcaagtgtctcctccctccagcacgtctgaaaccgacaccatcaagcgcgtcccctgcgagacaccccccttcacgcctcaagaaagcaatcccaccgcactgcttcaaccgctccatccctcgctccttctcctccctcctctgcgacatcttcatatcctcctgcctctactacttcgccaccgcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30905 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaaacgcgtcccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30906 - DNA, 349 bp, Artificial
  Mutation in BnaA.FAD2.a introduced by TALE nuclease pair BnFAD2_T03
caggatccatgggtgcatgtggaagaatgcaagtgtctcctccctccaaaaagtctgaaaccgacaacatcaagcgcgtaccctgcgagacaccgcccttcactgtgaactcaagaaagcaatcccaccccactgtttcatacgctcgctccctcgctctctctcctacctcatctgtgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30907 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtatagaacccaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 30908 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgagtgcggccaccacgccttcagcgactac

SEQ ID NO: 30909 - DNA, 411 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggaccggcgcacgcgctctggaggccttgctcacggtggcgggagagttgagaggtccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30910 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccatcacgccttcagcgactac

SEQ ID NO: 30911 - DNA, 409 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgcactgacgggtgccccgctcaacttgaccccccagcaggtggtggccatcgccagcaataatggtggcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 30912 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 30913 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacagaactcaagaaagctatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30914 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgcttcaaacgctccatcccacgctccttctcctcttcgacatcatcatctcctcctcgactcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30915 - DNA, 325 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcactgtttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30916 - DNA, 294 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgaatgcggccaccacgccttcagcgactac

SEQ ID NO: 30917 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30918 - DNA, 331 bp, Artificial
  Mutation in BnaA.FAD2.a introduced by TALE nuclease pair BnFAD2_T03
caggatccattggtgcaggtggaagaatgcaagtgtctcctccctccaagaagtctgaaaccgacaccatcaagcgcgtaccctgcgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30919 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30920 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttcactcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30921 - DNA, 370 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 30922 - DNA, 422 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaacatcaagcgcgtaccctgcgagacaccgcccttcactgtgtggataaccgtattaccgcctttgagtgagctgataccgctcgccgcagccgaacgaccgagcgcagcgagagaactcaagaaagcaatcccaccgcactgtttcaaacgctcgatccctcgctctttctcctacctcatctgggacatcatcatagcctcctgcttatactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30923 - DNA, 342 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccctgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30924 - DNA, 349 bp, Artificial
  Mutation in BnaA.FAD2.a introduced by TALE nuclease pair BnFAD2_T03
caggatccatgggtgcaggtggaagaatgcaagtgtctcctcactccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30925 - DNA, 369 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtacggaggtttgtttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 30926 - DNA, 345 bp, Artificial
  Mutation in BnaA.FAD2.a introduced by TALE nuclease pair BnFAD2_T03
caggatccatgggtgcaggtggaagaatgcaagtgtctgctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 30927 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 30928 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcacgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30929 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30930 - DNA, 336 bp, Artificial
  Mutation in BnaA.FAD2.a introduced by TALE nuclease pair BnFAD2_T03
caggatccatgggtgcaggtggaagaatgcaagtgtctcccccctccaaaaagtctgaaaccgacaacatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttaccgcgcctcacccctctactgggcctgccaaggcggcgtcctaacgggcctctgggtcatagcccacgagtgcggccaccacgccttcagcgactac

SEQ ID NO: 30931 - DNA, 366 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcacattaaccagctgcattaatgaatcggccaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 30932 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 30933 - DNA, 308 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30934 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30935 - DNA, 345 bp, Artificial
  Mutation in BnaA.FAD2.a introduced by TALE nuclease pair BnFAD2_T03
caggatccatgggtgcaggtggaagaattcaagtgtctcctccctccaaaaagtctgaaaccgacaacatcaagcgcgtaccctgcgagacaccgccctttataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 30936 - DNA, 392 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgcctgcttgccaccgccattgctggcgatggccaccacctttgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttgagcgactac

SEQ ID NO: 30937 - DNA, 343 bp, Artificial
  Mutation in BnaA.FAD2.a introduced by TALE nuclease pair BnFAD2_T03
caggatccatgggtgcaggtggaagaatgcaagtctctcctccctacaagaagtctgaaaccgacaccatcaagcgcgtaccctgcgagacaccgcccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30938 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttactttcctctcctccctcaccctctctcctacttcgcctggcctctctactgggcctgccagggctgcgtcctaaccggcgtctgggtcatagcccacgagtgcggccaccacgccttcagcgactac

SEQ ID NO: 30939 - DNA, 356 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccaagggtgcgtcctaaccggcgtctgggtcatagcccacgagtgcggccaccacgccttcagcgactac

SEQ ID NO: 30940 - DNA, 319 bp, Artificial
  Mutation in BnaA.FAD2.a introduced by TALE nuclease pair BnFAD2_T03
caggatccatgggtgcaggtggaagaatgcaagtgtcttcttccttcaaaaagtctgaaaccgacaacatcaagcgcgtaccctgcgagacaccgcccgtcactgtttcaaacgctcgatccctcgctctttctcctccctcatctgggacatcatcatagcctcctgcttctactacgtcgccaccacgtacttccctctcctccctcaccctctctcctacttcgcctggcctctctactgggcctgccaagggtgcgtactaacgggcctctgggtaatagcccacgagtgcggccaccacgccttcagcgactac

SEQ ID NO: 30941 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 30942 - DNA, 349 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 30943 - DNA, 295 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30944 - DNA, 277 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 30945 - DNA, 430 bp, Artificial
  Mutation in BnaA.FAD2.a introduced by TALE nuclease pair BnFAD2_T03
caggatccatgggtgcaggtggaagaatgcaagtgtctcctccctccaaaaagcctgaaaccgacaacatcaaacgcgtaccctgcgaaacaccgcccttccatttggtacaccgccctacaccgcccttcacacgcccgccataaactgccaggcatcaaactaagcagaaggccatcctgacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30946 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacctgcgtctgggtcatagcccacgagtgcggccaccacgccttcagcgactac

SEQ ID NO: 30947 - DNA, 350 bp, Artificial
  Mutation in BnaA.FAD2.a introduced by TALE nuclease pair BnFAD2_T03
caggatccatgggtgcaggtggaagaatgcaagtgtcacctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacggcttcagcgactac

SEQ ID NO: 30948 - DNA, 345 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgcctgcagcgactac

SEQ ID NO: 30949 - DNA, 336 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcgtccaccacgccttcagcgactac

SEQ ID NO: 30950 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 30951 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcgtccaccacgccttcagcgactac

SEQ ID NO: 30952 - DNA, 345 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 30953 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcatgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 30954 - DNA, 345 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30955 - DNA, 348 bp, Artificial
  Mutation in BnaA.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaaccggcgtctgggtcatagcccacgagtgcggccaccgcgccttcagcgactac

SEQ ID NO: 30956 - DNA, 350 bp, Artificial
  Mutation in BnaA.FAD2.a introduced by TALE nuclease pair BnFAD2_T03
catgatccatgggtgcaggtggaagaatgcaagtgtctcctccctccaaaaagtctgaaaccgacaacatcaagcgcgtaccctgcgagacaccgcccttcactgtagaacacaagaaagcaatcccaccgccctgtttcaaacgctcgatccctcgctctttctcctacctcctctggggcatcatcatagcctcctgcttctactacgtcgccaccacttacttccctctcctccctccccctctctcccactccccctctcctctctactgggcctgccatggctgcgtcctaaccggcgtctgggtcatagcccacgagtgcggccaccacgccttcagcgactac

SEQ ID NO: 30957 - DNA, 340 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30958 - DNA, 372 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctcagcggctgttgccggtgctgtgccaggcccccgctcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgtccaccacgccttcagcgactac

SEQ ID NO: 30959 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctattgggcctgccagggctgcgtcctaaccggcgtctgggtcatagcccacgagtgcggccaccacgccttcagcgacac

SEQ ID NO: 30960 - DNA, 338 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggccctgccaggggtgcgtcctacccggcgtctggttcatagcccacgagtccggccacccctcctgctgcgactac

SEQ ID NO: 30961 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctggcctctctactgggcctgccaagggtgcgtcctaaccggcgtctgggtcatagcccacgagtgcggccaccacgccttcagcgactac

SEQ ID NO: 30962 - DNA, 350 bp, Artificial
  Mutation in BnaA.FAD2.a introduced by TALE nuclease pair BnFAD2_T03
caggatccatgggtgcaggcggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgcgcctgccagggctgcgtcctaaccggcgtctgggtcatagcccacgagtgcggccaccacgccatcagcgactac

SEQ ID NO: 30963 - DNA, 344 bp, Artificial
  Mutation in BnaA.FAD2.a introduced by TALE nuclease pair BnFAD2_T03
gcaggatccatgggtgcaggtggaagaatgcaagtctctcctccctccagctcccccggaaccaacaccctcaaacgcgtcccctgcgagacaccaccagagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30964 - DNA, 410 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccaccattgagcggattagtcctactcaggagagcgctcaccgacaaacaacagataaaacgaaaggcccagtcttccctcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30965 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30966 - DNA, 345 bp, Artificial
  Mutation in BnaA.FAD2.a introduced by TALE nuclease pair BnFAD2_T03
caggatccatgggtgcaggtggaagaatgcaagtgtctcctgcctccaaaaagtctgaaaccgacaacatcaagcgcgtaccctgcgagacacctcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtccgaacgggcctctgggtcatcgcccactaatgcggccaccacgccctcagcaactac

SEQ ID NO: 30967 - DNA, 318 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 30968 - DNA, 349 bp, Artificial
  Mutation in BnaA.FAD2.a introduced by TALE nuclease pair BnFAD2_T03
caggaccatgggtgcaggtggaagaatgcaagtctctcctccctccagctcccccgaaaccaaaaccctcaaacgcgtcccctgcgagacaccacccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30969 - DNA, 344 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattagacctcaagaaagcaatcccaccgcactgtttcaaacgctcgatccctcgctctttctcctacctcatctgggacatcatcatagcctactgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 30970 - DNA, 410 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgactcaagacgatagttaccggataaggcgcagcggtcgggctgaacggggggtcgaggagaactcaagaaagcaatcccaccgcactgtttcaaacgctcgatccctcgctctttctcctacctcatctgggacatcatcatagcctcctgcttctactacgtcgccaccacttacttccctctactccctcaccctctctcctacttcgcctggcctctctactgggcctgccaaggctgcgtcctaacgggcctctgggtcatcgcccacgaatgcggccaccacgccttcagcgactac

SEQ ID NO: 30971 - DNA, 352 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 30972 - DNA, 334 bp, Artificial
  Mutation in BnaA.FAD2.a introduced by TALE nuclease pair BnFAD2_T03
caggatccatgggtgcaggtggaagaatgcaagtgtctcctcccaccaaaaagtctgaaaccgacaacatcaagcgcgtaccctgcgagacaccgcccttcactgtaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgcctgcagcgactac

SEQ ID NO: 30973 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacactcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30974 - DNA, 341 bp, Artificial
  Mutation in BnaA.FAD2.a introduced by TALE nuclease pair BnFAD2_T03
caggatccatgggtgcaggtggaagaatgcaagtgtcccctccctccaaaaagtctgaaaccgacaacatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30975 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcttggtcatagcccacgagtgcggccaccacgccttcagcgactac

SEQ ID NO: 30976 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggtctctctactgggcctgccagggctgcgtcctaacgggcctctgggtcatagcccacgagtgcggccactacgccttcagcgactac

SEQ ID NO: 30977 - DNA, 350 bp, Artificial
  Mutation in BnaA.FAD2.a introduced by TALE nuclease pair BnFAD2_T03
caggatccatgggtgcaggtggaagaatgcaagtgtctcatccctccaaaaagtctgaaaccgacaacctcaagcgcgtaccctgcgagacaccgcccttcactgtagaactcaagaaagcaatcccaccgcactgtttcaaacgctcgatccctcactctttctcctacctcatctcggacatcatcatagcatcctgcttctactacgtcgccaccacctacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30978 - DNA, 348 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcatggcctctctactgggcctgccagggctgcgtcctaaccggcgtctgggtcatagcccacgagtgcggccaccacgccttcagcgactac

SEQ ID NO: 30979 - DNA, 391 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtacggtccagcggctgttgccggtgctgtgccaggcccacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30980 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 30981 - DNA, 419 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccagcggctgttaccgatgctgtgccaggcccacggcttgacccccccacaggtggtggccatcggagaactcaagaaagcaatcccaccgcactggttcaaacgctcgatccctcgctctttctcctacctcatctggcacatcatcatagcctcctgcttctacgacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30982 - DNA, 343 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcggaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30983 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcctctgggtcatagcccacgagtgcggccaccacgccttcagcgactac

SEQ ID NO: 30984 - DNA, 402 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30985 - DNA, 349 bp, Artificial
  Mutation in BnaA.FAD2.a introduced by TALE nuclease pair BnFAD2_T03
caggatccatgggtgcagtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcctggcctctctactgggcctgccagggctgcgtcctaaccggcgtctgggtcatagcccacgagtgcggccaccacgccttcagcgactac

SEQ ID NO: 30986 - DNA, 392 bp, Artificial
  Mutation in BnaA.FAD2.a introduced by TALE nuclease pair BnFAD2_T03
caggatcatgggtgcagatcaaagaatgcaagtgtctcctcactccaaaaagtctgaaaccgacaacatcaagcgcgtaccctgcgagacaccgcccttcactgccggtgctgtgccaggccacggcttgaccccccagcaggtggtgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 30987 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccaccgcactgtttcaaacgctcgatccatcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30988 - DNA, 343 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagtgctgcgtcctaaccggcgtctgggtcatagcccacgagtgcggccaccacgccttcagcgactac

SEQ ID NO: 30989 - DNA, 342 bp, Artificial
  Mutation in BnaA.FAD2.a introduced by TALE nuclease pair BnFAD2_T03
caggatccatgggtgcaggtggaagaatgcaagtgtcttctccctccaagaagtctgaaacctacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30990 - DNA, 351 bp, Artificial
  Mutation in BnaA.FAD2.a introduced by TALE nuclease pair BnFAD2_T03
caggatccatgggtgcaggtgaaagaatgcaagtgcctcctccctccaagaagtctgaaaccgacaccatcaagcgcgtaccctgcgagacacctcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30991 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30992 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctacttcgcctggcctctctactgggcctgccagggctgcgtcctaaccggcgtctgggtcatagcccacgagtgcggccaccacgccttcagcgactac

SEQ ID NO: 30993 - DNA, 349 bp, Artificial
  Mutation in BnaA.FAD2.a introduced by TALE nuclease pair BnFAD2_T03
caggatccatgggtgcaggtggaagaatgcaagtgtcacctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30994 - DNA, 436 bp, Artificial
  Mutation in BnaA.FAD2.a introduced by TALE nuclease pair BnFAD2_T03
caggatccatgggtgcaggttgaagaatgcaagtgtctcctccctccaagaagtctgaaaccgacaccatcaagcgcgtaccctgcgagacaccgcccttcactgtgggcttgaccccccagcaggtggtggccatcgccagcaataatggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgaatgcggccaccacgccttcagcgactac

SEQ ID NO: 30995 - DNA, 404 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgccaggcccacggcttgaccccggagcaggtggtggccatcgcgtcgattttgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 30996 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 30997 - DNA, 413 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctaaagactgggcctttcgttttatctgttgtttgtcggtgaacgctctcctgagtaggacaaatccgcctgagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 30998 - DNA, 354 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcagagcccacgagtgcggccaccacgccttcagcgactac

SEQ ID NO: 30999 - DNA, 348 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccagggctgcgtcctaaccggcgtctgggtcatagcccacgagtgcggccaccacgccttcagcgactac

SEQ ID NO: 31000 - DNA, 384 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcagactgagcctttcgttttatctgttgtttgtcggtgaacgctctcctgagtaggtcaaatccgctctgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31001 - DNA, 411 bp, Artificial
  Mutation in BnaA.FAD2.a introduced by TALE nuclease pair BnFAD2_T03
caggatccatgggtgcaggtggaagaatgcaagtgtctcccacctccaaaaagtctgaaaccgacaacatcaagcgcgtaccctgcgagacaccgcccttcactgtcgactcaagacgatagttaccggataaggcgcagcggtcgggctgaacggggggtcgaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccgccacgcccttgagcgactac

SEQ ID NO: 31002 - DNA, 351 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31003 - DNA, 350 bp, Artificial
  Mutation in BnaA.FAD2.a introduced by TALE nuclease pair BnFAD2_T03
caggatccatgggtgcaggtggaagaatgcaagtgtctcctccatacaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31004 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcttgccaaggctgcgtcctaacgggcctctgggtcatcgcccacgaatgcggccaccacgccttcagcgactac

SEQ ID NO: 31005 - DNA, 304 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcaatcccaccgcactgtttcaaacgcttgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31006 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcacgtaccctgcgagacaccgcccttcactgaagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31007 - DNA, 348 bp, Artificial
  Mutation in BnaA.FAD2.a introduced by TALE nuclease pair BnFAD2_T03
caggatccatgggtgcaggtggaagaatgcaagtgtcccctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccgtcgcgactac

SEQ ID NO: 31008 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaaactcaagaaagcaatcccaccgcactgtttcaaccgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31009 - DNA, 319 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 31010 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcagaactcaagaaagcaatcccaccgcactgtttcaaacgctccatccctcgctccttctcctacctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcggcgactac

SEQ ID NO: 31011 - DNA, 345 bp, Artificial
  Mutation in BnaA.FAD2.a introduced by TALE nuclease pair BnFAD2_T03
caggatccatgggtgcaggtggaagaatgcaagtgtcccctccatccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31012 - DNA, 422 bp, Artificial
  Mutation in BnaA.FAD2.a introduced by TALE nuclease pair BnFAD2_T03
caggatccatgggtgcaggtggaagaatgcaagtgtctactccctccaaaaagtctgaaaccgacaacatcaagcgcgtaccctgcgagacaccgcccttcactgtcggctggcgatggccaccacctgctccggggtcaagccgtgggcctggcacagcaccggcaagcaggcactggagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccagggctgcgtcctaaccggcgtctgggtcatagcccacgagtgcggccaccacgccttcagcgactac

SEQ ID NO: 31013 - DNA, 334 bp, Artificial
  Mutation in BnaA.FAD2.a introduced by TALE nuclease pair BnFAD2_T03
caggatccatgggtgcaggcggaagaatgcaagtgtcacctcccaccaaaaagtctgaaaccgacaacatcaagcgcgtaccctgcgagacaccgcccttcactgggaactcaagaaagcaatcccaccgcactgtttcaaacgctcgatccctcgctctttctcctacctcatctgggacatcatcatagcctcctgcttctaccacctctccacagcctacttccctctcccttacctcgcctgacccctctactgggcctgcctagggtgcgtcctaaccggcgtctgggtcatagcccacgagtgcggccaccgcgccatgagcgactac

SEQ ID NO: 31014 - DNA, 350 bp, Artificial
  Mutation in BnaA.FAD2.a introduced by TALE nuclease pair BnFAD2_T03
caggatccatgggtgcaggtggaagaatgcaagtgtcccctccacacaagaagtctgaaaccgacaccaaccagcgcgtaccctacgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactggggctgccagggctgcgtcctaaccggcgtctgggtcatagcccacgagtgcggccaccacgccttcagcgactac

SEQ ID NO: 31015 - DNA, 350 bp, Artificial
  Mutation in BnaA.FAD2.a introduced by TALE nuclease pair BnFAD2_T03
caggatccatgggtgcaggtggaagaatgcaagtgtccccttcaaacaaaaagtctgaaaccgacaacatcaagcgcgtaccctgcgagacaccgcccttcaccgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggttcatatcccacgagtgcggccaccacgccttcagcgactac

SEQ ID NO: 31016 - DNA, 314 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 31017 - DNA, 335 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31018 - DNA, 412 bp, Artificial
  Mutation in BnaA.FAD2.a introduced by TALE nuclease pair BnFAD2_T03
caggatccatgggtgcaggtggaagaatgcaagtatctactacctccaagaagtctgaaaccgacaccatcaagcgcgtaccctgcgagacaccgccctttacgtgaaccatcgccctgatagacggtttttcgccctttgacgttggagtccacgttctttaatagtggaactcaagaaagcaatcccaccgcactgtttcaaacgctcgatccctcgctctttctcctacctcatctgggacatcatcatagcctcctgcttctactacgtcgccaccgcttacttccctctcctccctcaccctctctcctacttcgcctggtctctctactgggcctgccagggctgcgtcctaaccggcgtctgggtcatagcccacgagtgcggccaccacgccttcagcgactac

SEQ ID NO: 31019 - DNA, 350 bp, Artificial
  Mutation in BnaA.FAD2.a introduced by TALE nuclease pair BnFAD2_T03
caggatccatgggtgcaggttgaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31020 - DNA, 342 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31021 - DNA, 280 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctaccgggcctgccagggctgcgtcctaaccggcgtctgggtcatagcccacgagtgcggccaccacgccttcagcgactac

SEQ ID NO: 31022 - DNA, 455 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaacagccgctggaccgtctccagcgcctgcttgccaccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31023 - DNA, 344 bp, Artificial
  Mutation in BnaA.FAD2.a introduced by TALE nuclease pair BnFAD2_T03
caggatccatgggtgcaggtggaagaatgcaagtgtcttctcccttcaaaaagtctgataccgacaacatcacgcgcgtaccctgcgagacaccgcccgtcactgtcaagaaagcaatcccaccgcactgtttcaaccgctcgatccctcgctctttctcctacctcacctgggacatcatcatagcctcctgcttctactacgtcgccaccacgtacttccctctcctccctcaccctctctcctacttcgcctggcctctctactgggcctgccaagggtgcgtcctaaccggcgtctgggtcatagcccacgagtgcggccaccgcgccttcagcgactac

SEQ ID NO: 31024 - DNA, 346 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccagggctgcgtcctaaccggcgtctgggtcatagcccacgagtgcggccaccacgccttcagcgactac

SEQ ID NO: 31025 - DNA, 381 bp, Artificial
  Mutation in BnaA.FAD2.a introduced by TALE nuclease pair BnFAD2_T03
caggatcatgggtgcaggtggaagaatgcaagtgtctcctccctccaaaaagtctgaaaccgacaacatcaagcgcgtaccctgcgagacaccgcccttcactgttgagcggggcacccgtcagtgcattgcgccagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31026 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccgagggtgcgtcctaaccggcgtctgggtcatagcccacgagtgcggccaccacgccttcagcgactac

SEQ ID NO: 31027 - DNA, 346 bp, Artificial
  Mutation in BnaA.FAD2.a introduced by TALE nuclease pair BnFAD2_T03
cgggatccatgggtgcaggtggaagaatgcaagtgtctcctccctccaaaaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31028 - DNA, 463 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtggcgatggcggcaagcaggcgctggagacggtccagcggctgttgccggtgctgtgccaggcccacggcttgaccccggagcaggtggtggccatcgccagcaataatggtgtagaactcaagaaagcaatcccaccgcactgtttcaaacgctcgatccctcgctctttctcctaccccatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 31029 - DNA, 350 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatggcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 31030 - DNA, 354 bp, Artificial
  Mutation in BnaA.FAD2.a introduced by TALE nuclease pair BnFAD2_T03
caggatccatgggtgcaggtgaaagaatgcaagtgtctcctccctccaaaaagtctgaaaccgacaacatcaagcgcgtaccctgcgagacaccgcccttcactgtccggagaactcaagaaagcaatcccaccacactgtttcaaacgctcgatccctcgctctttctcctacctcctcttcgacatcctcgtctcctcctccctctaccacctctccacagcctacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 31031 - DNA, 440 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctccccccagcaggtggtggccatcgccagcaatggcggtggcaagcaggcgctggagacggtccagcggctgttgccggtgctgtgccaggagacctcaagaaagcaatcccaccgcactgtttcaaacgctcgatccctcgctctttctcctccctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31032 - DNA, 413 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtcggccatcgccagcaatggcggtggcaagcaggcgctggagacggtccagcggctgttgccggagaactcaagaaagcaatcccaccgcactgtttcaaccgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31033 - DNA, 373 bp, Artificial
  Mutation in BnaA.FAD2.a introduced by TALE nuclease pair BnFAD2_T03
caggatccatgggtgcaggtgaaagaatgcaagtgtctcctccctccaaaaagtctgaaaccgacaacatcaagcgcgtaccctgcgagacactgccaggcatcaaactaagcagaaggccatccgtcaaacgctcaagaaagcaatcccaccgcactgtttcaaacgctcgatccctcgcgctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31034 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31035 - DNA, 349 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31036 - DNA, 339 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgccctttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31037 - DNA, 337 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccagggctgcgtcctaaccggcgtctgggtcatagcccacgagtgcggccaccacgccttcagcgactac

SEQ ID NO: 31038 - DNA, 402 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31039 - DNA, 350 bp, Artificial
  Mutation in BnaA.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtagaactcaagaaagcaatcccaccgcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31040 - DNA, 344 bp, Artificial
  Mutation in BnaA.FAD2.a introduced by TALE nuclease pair BnFAD2_T03
caggatccatgggtgcaggtggaagaatgcaagtgtctcccccctccaaaaagtctgaaaccgacaccatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31041 - DNA, 350 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31042 - DNA, 349 bp, Artificial
  Mutation in BnaA.FAD2.a introduced by TALE nuclease pair BnFAD2_T03
caggatccatgggtgcaggcggaagaatgcaagtgtctcctccctccaaaaagtctgaaaccgacaacatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 31043 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctacttcgcctggcctctctactgggcctgccagggctgcgtcctaaccggcgtctgggtcatagcccacgagtgcggccaccacgccttcagcgactac

SEQ ID NO: 31044 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31045 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttgcctctctactgggcctgccagggctgcgtcctaaccggcgtctgggtcatagcccacgagtgcggccaccacgccttcagcgactac

SEQ ID NO: 31046 - DNA, 350 bp, Artificial
  Mutation in BnaA.FAD2.a introduced by TALE nuclease pair BnFAD2_T03
caggatccatgggtgcaggtggaagaatgcaagtgactcctccctccaaaaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31047 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgtgcctgccaagggtgcgtcctatccggcgtctgggtcatagcccacgagtgtggccaccacgccttcagcgactac

SEQ ID NO: 31048 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccatcaaacgcgtcccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31049 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaacccgacaacatcaagcgcgtaccctgcgagacaccgcccttcactgactcaagaaagcaatcccaccgcactgtttcaaacgctcgatccctcgctctttctcctacctcatctgggacatcatcatagcctcctcggctcctccctctaccacctctccacagcctacttccctctcccttacctcgcctgacccctctactgggcctgccaaggctgcgtcctaacgggcctctgggtcatagcccacgagtgcggccaccacgccgtcagcgactac

SEQ ID NO: 31050 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccgacgtctgggtcatagcccacgagtgcggccaccacgccttcagcgactac

SEQ ID NO: 31051 - DNA, 456 bp, Artificial
  Mutation in BnaA.FAD2.a introduced by TALE nuclease pair BnFAD2_T03
caggatccatgggtgcaggtggaagaatgcaagtggctcctccctccaaaaagtctgaaaccgacaacatcaagcgcgtaccctgcgagacaccgcccttcactgtcggcggctgttgccggtgctgtgccaggcccacggcttgaccccggagcaggtggtggccatcgccagcaatattggtggccagcaggcgctggagacggtgcaggagaactcaagaaagcaatcccaccgcactgtttcaaacgctcgatcccccgctctttctcctacctcatctgggacatcatcatagcctcctgcttctacgacggcgccaccacttacttccctctcctccctcaccctctctcctacttcgcctggcctctctactgggcctgccagggctgcgtcctaaccggcgtcggggtcatagcccacgagtgcggccaccacgccttcagcgactac

SEQ ID NO: 31052 - DNA, 349 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtctggcctctctactgggcctgccagggctgcgtcctaaccggcgtctgggtcatagcccacgagtgcggccaccacgccttcagcgactac

SEQ ID NO: 31053 - DNA, 350 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31054 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagctactac

SEQ ID NO: 31055 - DNA, 408 bp, Artificial
  Mutation in BnaA.FAD2.a introduced by TALE nuclease pair BnFAD2_T03
caggatccatgggtgcaggtggaagaatgtaagtgtctcctccctccaaaaagtctgaaaccgacaacatcaagcgcgtaccctgcgagacaccgcccttcactgtcggggtcaagccgtgggcctggcacagcaccggcaacagccgctggaccgtctccaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtcggggtcatagcccgcgagtgcggccaccacgccttcagcgactac

SEQ ID NO: 31056 - DNA, 319 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcatcgactac

SEQ ID NO: 31057 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31058 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttccaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31059 - DNA, 346 bp, Artificial
  Mutation in BnaA.FAD2.a introduced by TALE nuclease pair BnFAD2_T03
caggatccatgggtgcaggtagaagaatgcaagtgtctcctccctccaagaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31060 - DNA, 308 bp, Artificial
  Mutation in BnaA.FAD2.a introduced by TALE nuclease pair BnFAD2_T03
caggatccatgggtgcaggtggaagaatgcaagtgtctcatccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31061 - DNA, 348 bp, Artificial
  Mutation in BnaA.FAD2.a introduced by TALE nuclease pair BnFAD2_T03
caggatccatgggtgcaggtggaagaatgcaagtctctcatcccaccagctcccccgaaaccaaaaccctcaaacgcgtcccctgcgagacaccacccttcactcgacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccgtcagcgactac

SEQ ID NO: 31062 - DNA, 346 bp, Artificial
  Mutation in BnaA.FAD2.a introduced by TALE nuclease pair BnFAD2_T03
caggatccatgggtgcaggtcgaagaatgcaagtgtcccctccacccaaaaagtctgaacccgacaacaacaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggggcatagcccacgagtgcggccaccacgccttcagcgactac

SEQ ID NO: 31063 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacactcaagaaagcaatcccaccgcactgtttcaaacgctcgatccctccctctttctcctacctcatctgggacatcatcatagcctcctgcttctactacgtcgccaccccttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31064 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccccccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31065 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 31066 - DNA, 347 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagcgcgtaccctgcgagacaccgcccttcaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaacggtgcgtcctaaccggcgtctgggtcatagcccacgagtgcggccaccacgccttcagcgactac

SEQ ID NO: 31067 - DNA, 350 bp, Artificial
  Mutation in BnaA.FAD2.a introduced by TALE nuclease pair BnFAD2_T03
caggatccatgggtgcaggcggaagaatgcaagtgtctccttcctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31068 - DNA, 347 bp, Artificial
  Mutation in BnaA.FAD2.a introduced by TALE nuclease pair BnFAD2_T03
caggatccatgggtgcaggtggaagaacgcaagtctctcctccctccagctcccccggaaccaacaccctcaaacgcgtcccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 31069 - DNA, 351 bp, Artificial
  Mutation in BnaA.FAD2.a introduced by TALE nuclease pair BnFAD2_T03
caggatccatgggtgcaggtggaagaatgcaagtgtctcatccctccaaaaagtctgaaaccgacaacatcaagcgcgtaccctgcgagacgccgcccttcactgtgagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31070 - DNA, 383 bp, Artificial
  Mutation in BnaA.FAD2.a introduced by TALE nuclease pair BnFAD2_T03
caggatccatgggtgcaggtgcaagaatgcaagtgtcccctccctccaaaaagtctgaacccgacaacatcaagcgcgtaccctgcgagacaccgcccttcactgtaacgaccttttggaaacttcggcttcccctgaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 31071 - DNA, 356 bp, Artificial
  Mutation in BnaA.FAD2.a introduced by TALE nuclease pair BnFAD2_T03
caggatccatgggtgcaggtggaagaatgcaagtgtctcctcccaccaaaaagtctgaaaccgacaacatcaagcgcgtaccctgcgagacaccgcccttcacttcttccaccgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccatgccttcagcgactac

SEQ ID NO: 31072 - DNA, 384 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcacctgcgagacaccacccttccccggagcaggtggtggccatcgccagcaatattggtggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31073 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31074 - DNA, 350 bp, Artificial
  Mutation in BnaA.FAD2.a introduced by TALE nuclease pair BnFAD2_T03
caggatccatgggtgcaggtggaagaatgcaagtgtctcccccctccaaaaagtctgaaaccgacaacatcaaccgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31075 - DNA, 319 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggcctgcgtcctatccggcgtctggttcatagcccacgagtgctgccaccgcgccttcagcgactac

SEQ ID NO: 31076 - DNA, 350 bp, Artificial
  Mutation in BnaA.FAD2.a introduced by TALE nuclease pair BnFAD2_T03
caggatccatgggtgcaggtgcaagaatgcaagtgtctcctccaaccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggggcatagcccacgagtgcggccaccacgccttcagcgactac

SEQ ID NO: 31077 - DNA, 351 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31078 - DNA, 394 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagcgcgtaccctgcgagacaccgcccttcactgtatcgacaaataatgattttattttgactgatagtgacctgttggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatatcccacgagtgcggccaccacgccttcagcgactac

SEQ ID NO: 31079 - DNA, 309 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31080 - DNA, 309 bp, Artificial
  Mutation in BnaA.FAD2.a introduced by TALE nuclease pair BnFAD2_T03
caggatccatgggtgcaggtggaagcatgcaagtctgccacgcgtccaaaaagtctgaaaccgacaacatcaaaccgacaacacccaccgcactgtttcaaacgctcgatccctcgctctttctcctacctcatctgggacatcatcatagcctcctgcttctactacggcgccaccacttacttccttctcctccctcaccctctctcctacttcgcctggcccctctactgggcctgccaaggctgcgtcctaacgggcctctgggtcatcgcccacgaatgcggccaccacgccatcagcgactac

SEQ ID NO: 31081 - DNA, 422 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgtggataaccgtattaccgcctttgagtgagctgataccgctcgccgcagccgaacgaccgagcgcagcgagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31082 - DNA, 347 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcatgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31083 - DNA, 349 bp, Artificial
  Mutation in BnaA.FAD2.a introduced by TALE nuclease pair BnFAD2_T03
caggatccatgggtgcaggtggaagaatgcaagtgtctcatccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31084 - DNA, 305 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcataaccggcgtctgggtcatagcccacgagtgcggccaccacgccttcagcgactac

SEQ ID NO: 31085 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggactgcgtcctaaccggcgtctgggtcatagcccacgagtgcggccaccacgccttcagcgactac

SEQ ID NO: 31086 - DNA, 428 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgttgcgcgtaaccaccacacccgccagcgccctagcgcccgctcctttcgctttcttcccttcctttctcgccacgttcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31087 - DNA, 346 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgtttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31088 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcaaggctgcgtcctaacgggcctctgggtcatagcccacgagtgcggccaccacgccttcagcgactac

SEQ ID NO: 31089 - DNA, 415 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagagcggatttgtcctactcaggagagcgttcaccgacaaacaacagataaaacgaaaggctcagagacctcaagaaagcaatcccacctcactgcttcaaacgctccatccctcgctccttctcctacctcatctgggacatcatcatagcctcctgcttctactacgtcgccaccacttccttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 31090 - DNA, 333 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgagcccccgatttagagcttgacggggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcctctctactgggcctgccagggctgcgtcctaaccggcgtctgggtcatagcccacgagtgcggccaccacgccttcagcgactac

SEQ ID NO: 31091 - DNA, 444 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgtgggcctggcacagcaccggcaacagcgcctgcaccgtctcccgcgctggtttgccaccaatattgctggcgatggccaccacctgctacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31092 - DNA, 350 bp, Artificial
  Mutation in BnaA.FAD2.a introduced by TALE nuclease pair BnFAD2_T03
caggatccatgggtgcaggtggaagaatgcaagtctcccctccatccagctcccccgaaaccaaaaccatcaaacgcgtcccctgcgagacaccacccttcactggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31093 - DNA, 350 bp, Artificial
  Mutation in BnaA.FAD2.a introduced by TALE nuclease pair BnFAD2_T03
caggatccatgggtgcaggtggaagaatgcaagtgtctcccccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgctgccaccacgccttcagcgactac

SEQ ID NO: 31094 - DNA, 347 bp, Artificial
  Mutation in BnaA.FAD2.a introduced by TALE nuclease pair BnFAD2_T03
caggatccatgggtgcaggtggaagaatgcaagtgtatcatccctccaaaaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtccgaaccggcgtctgggtcacagcccacgattgcggcgtccacgccatcagcgactac

SEQ ID NO: 31095 - DNA, 351 bp, Artificial
  Mutation in BnaA.FAD2.a introduced by TALE nuclease pair BnFAD2_T03
caggatccatgggtgcaggtggaagaatgcaagtgtctccatcctccaagaagtctgaaaccgacaccatcaagcgcgtaccctgcgagacaccgccattcactgtaagaactcaagaaagcaatcccaccgcactgtttcaaacgctcaatccctcgctctttctcctacctcatctgggacatcatcatagcctcctgcttctactacggcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31096 - DNA, 344 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31097 - DNA, 350 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 31098 - DNA, 343 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcctcttcgacatcctcgtctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31099 - DNA, 350 bp, Artificial
  Mutation in BnaA.FAD2.a introduced by TALE nuclease pair BnFAD2_T03
caggatccatgggtgcaggtggaagaatgcaagtctctcctccctccaaaaagtctgaacccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 31100 - DNA, 346 bp, Artificial
  Mutation in BnaA.FAD2.a introduced by TALE nuclease pair BnFAD2_T03
caggatccatgggtgcaggtcgaagaatgcaagtgtctcctccctccaaaaagtctgaaaccgacaacatcaagcgcgtaccctgcgagacaccgcccttcactgtcgcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31101 - DNA, 396 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggatggccttctgcttagtttgatgcctggcagtttatggcgggcatactcaagaaagcaatcccaccgcactgtttcaaacgcccgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 31102 - DNA, 345 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccctggcgacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31103 - DNA, 430 bp, Artificial
  Mutation in BnaA.FAD2.a introduced by TALE nuclease pair BnFAD2_T03
caggatccatgggtgcaggtggaagaatgcaagtgtatcctccctccaaaaagtctgaaaccgacaacatcaagcgcgtaccctgcgagacaccgcccttcactgagcggatttgaacgttgtgaagcaacggcccggagggtggcgggcgacgcccgccataaactgccaggcatcaaactaagcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31104 - DNA, 348 bp, Artificial
  Mutation in BnaA.FAD2.a introduced by TALE nuclease pair BnFAD2_T03
caggatccatgggtgcagttggaagaatgcaagtgtctcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcaagggtgcgtcctaaccggcgtctgggtcatagcccacgagtgcggccaccacgccttcagcgactac

SEQ ID NO: 31105 - DNA, 347 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31106 - DNA, 357 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcggtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 31107 - DNA, 349 bp, Artificial
  Mutation in BnaA.FAD2.a introduced by TALE nuclease pair BnFAD2_T03
caggatccatgggtgcaggtggaagaatgcaagtgtgaccaccctccaagaagtctgaacccgacaacatcaagcccgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccgccacgccttcatcgactac

SEQ ID NO: 31108 - DNA, 349 bp, Artificial
  Mutation in BnaA.FAD2.a introduced by TALE nuclease pair BnFAD2_T03
caggatccatgggtgcaggtggaagaatgcaagtctctcctccctccaagaagtctgaaaccgacaccatcaagcgcgtcccctgcgagacaccgcccttcactgagaactcaagaaagcaatcccaccgcactgtttcaaacgctcgatccctcgctctttctcctacctcatctgggacatcatcatagcctcctgcttctactacctcgccaccgcttacttccctctcctccctcaccctctctcctacttcgcctggcctctctactgggcctgccagggctgcgtcctaacgggcgtctgggtcatagcccacgagtgcggccaccacgccttcagcgactac

SEQ ID NO: 31109 - DNA, 349 bp, Artificial
  Mutation in BnaA.FAD2.a introduced by TALE nuclease pair BnFAD2_T03
caggatccatgggtgcaggtgaaagaatgcaagtgtatcaaccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31110 - DNA, 360 bp, Artificial
  Mutation in BnaA.FAD2.a introduced by TALE nuclease pair BnFAD2_T03
caggatccatgggtgcaggtggaagaatgcaagtgtctcccccctccaaaaagtctgaaaccgacaacatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31111 - DNA, 372 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgctcacatgttctttcctgcgttatcccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 31112 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagccaacgagtgcggccaccacgccttcagcgactac

SEQ ID NO: 31113 - DNA, 351 bp, Artificial
  Mutation in BnaA.FAD2.a introduced by TALE nuclease pair BnFAD2_T03
caggatccatgggtgtaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31114 - DNA, 344 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccagcgtctgggtcatagcccacgagtgcggccaccacgccttcagcgactac

SEQ ID NO: 31115 - DNA, 307 bp, Artificial
  Mutation in BnaA.FAD2.a introduced by TALE nuclease pair BnFAD2_T03
caggatccatgggtgcaggtggaagaatgcaagtgtctcctcctccaaaaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctcccccaccctctcccttacctcgcctggcccctctactgtgcctgccagggctgcgtcctaaccggcgtctgggtcatagcccacgagtgcggccaccacgccttcagcgactac

SEQ ID NO: 31116 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactggaactcaagaaagcaatcccaccgcactgtttcaaacgctcgatccctcgctatttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31117 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacctcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31118 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31119 - DNA, 350 bp, Artificial
  Mutation in BnaA.FAD2.a introduced by TALE nuclease pair BnFAD2_T03
caggatccatgggtgcaggtcgaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31120 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcctcgtctcctcctccctctaccacctctccacagcctacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 31121 - DNA, 411 bp, Artificial
  Mutation in BnaA.FAD2.a introduced by TALE nuclease pair BnFAD2_T03
caggatccatgggtgcaggtggaagaatgcaagtgtatcctccatccaagaagtctgaaaccgacaccatcaagcgcgtaccctgcgagacaccgcccttcactgtgtacgtgccccacgagtacatcgagctgatcgagatcgcccggaacagcacccaggaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31122 - DNA, 350 bp, Artificial
  Mutation in BnaA.FAD2.a introduced by TALE nuclease pair BnFAD2_T03
caggatccatgggtgcaggtcgaagaatgcaagtgtcccctccacacaagaagtctgaaaccgacaccaaccagcgcgtaccctgcgagacaccgcccttcactgtagaactcaagaaagcaatcccaccgcactgtttcaaacgctcgatccctctctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggtgcatagcccacgagtgcggccaccacgccttcagcgactac

SEQ ID NO: 31123 - DNA, 349 bp, Artificial
  Mutation in BnaA.FAD2.a introduced by TALE nuclease pair BnFAD2_T03
caggatccatgggtgcaggtgcaagaatgcaagtctcccctccatccagctcccccggacccaacaccctcaaacgcgtcccctgcgagacaccaccattcactcggacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31124 - DNA, 350 bp, Artificial
  Mutation in BnaA.FAD2.a introduced by TALE nuclease pair BnFAD2_T03
caggatccatgggtgcaggtggaagaatgcaagtgtctcccccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccatcagcaactac

SEQ ID NO: 31125 - DNA, 277 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgtcctaaccggcgtcttggtcatagcccacgagtgcggccaccacgccttcagcgactac

SEQ ID NO: 31126 - DNA, 349 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31127 - DNA, 331 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctaccgggcctgccagggctgcgtcctaaccggcgtctgggtcatagcccacgagtgcggccaccacgccttcagcgactac

SEQ ID NO: 31128 - DNA, 347 bp, Artificial
  Mutation in BnaA.FAD2.a introduced by TALE nuclease pair BnFAD2_T03
caggatccatgggtgcaggtggaagaatgcaagtgtttcttccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccatcagcgactac

SEQ ID NO: 31129 - DNA, 341 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctcggctcctccctctaccccctctccacagcctacttccctctcccttacctcgcctgacccctctacagggcctgccaaggctgcgtcctaacgggcctatgggtcatagcccacgaatgcggccaccacgccttcagcgacta

SEQ ID NO: 31130 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgcccgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31131 - DNA, 345 bp, Artificial
  Mutation in BnaA.FAD2.a introduced by TALE nuclease pair BnFAD2_T03
caggatccatgggtgcaggtggaagaatgcaagtgtctcccccctccaaaaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31132 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 31133 - DNA, 394 bp, Artificial
  Mutation in BnaA.FAD2.a introduced by TALE nuclease pair BnFAD2_T03
caggatccatgggtgcagggggaagaatgcaagtgtctcctccctccaaaaagtctgaaaccgacaacatcaagcgcgtaccctgcgagacaccgcccttcactgccggtgctgtgccaggcccacggcttgaccccccagcaggtggtgggaactcaagaaagcaatcccaccgcactgtttcaaacgctcgatccctcgctctttctcctacctcatctgggacatcatcatagcctcctgcttctactacggcgccacctcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31134 - DNA, 348 bp, Artificial
  Mutation in BnaA.FAD2.a introduced by TALE nuclease pair BnFAD2_T03
caggatccatgggtgcaggttgaagaatgcaagtgtctcctccctccaaaaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31135 - DNA, 435 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtcatcctcacctcctccagggtcagggtgccggcctttggtggcaagcaggcgctggagacggtccagcggctgttgccggtgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 31136 - DNA, 327 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31137 - DNA, 401 bp, Artificial
  Mutation in BnaA.FAD2.a introduced by TALE nuclease pair BnFAD2_T03
caggatccatgggtgcaggtggaagaatgcaagtgtcccctccctccaagaagtctgaaaccgacaacatcaagcgcgtaccctgcgagacaccgcccttcactgtgggccttgtagttgcccttgaagtggccggacacgaacaggaacttgaactagaactcaagaaagcaatcccaccgcactgtttcaaacgctcgatccctcgctctttctcctacctcatctgggacatcatcatagcctcctgcttctcctacgtcgccacctcttacttccctctcctccctcaccctctctcctacttcgcctggcctctctactgggcctgccagggctgcgtcctaaccggcgtctgggtcatcgcccacgaatgcggccaccacgccttcagcgactac

SEQ ID NO: 31138 - DNA, 349 bp, Artificial
  Mutation in BnaA.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactgagacctcaagaaagctatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatagcccacgagtgcggccaccacgccttcagcgactac

SEQ ID NO: 31139 - DNA, 331 bp, Artificial
  Mutation in BnaA.FAD2.a introduced by TALE nuclease pair BnFAD2_T03
caggatccatgggtgcaggtgaaagaatgcaagtgtcacctccctccaaaaagtctgaaaccgacaacatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 31140 - DNA, 345 bp, Artificial
  Mutation in BnaA.FAD2.a introduced by TALE nuclease pair BnFAD2_T03
caggatccatgggtgcaggtagaagaatgcaagtgtctccctcctccaaaaagtctgaaaccgacaacatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggggtctgggtcatagcccacgagtgcggccaccacgccgtcagcgactac

SEQ ID NO: 31141 - DNA, 351 bp, Artificial
  Mutation in BnaA.FAD2.a introduced by TALE nuclease pair BnFAD2_T03
caggatccatgggtgcaggtggaagaatgcaagtctctcctccctccaaaaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31142 - DNA, 350 bp, Artificial
  Mutation in BnaA.FAD2.a introduced by TALE nuclease pair BnFAD2_T03
caggatccatgggtgcagttggaagaatgcaagtgtctcctccctccaaaaagtctgaacccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctgacccctctactgggcctgccaaggctgcgtcctaacgggcctctgggtcatagcccacgagtgcggccaccacgccttcagcgactac

SEQ ID NO: 31143 - DNA, 397 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgagcaggtggtggccatcgccagccacgatggcggcaagcaggcgctggagaactcaagaaagcaatcccaccgcactgtttcaaacgctcgatccctcgctctttctcctacctcatctgggacatcatcatagccccctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31144 - DNA, 295 bp, Artificial
  Mutation in BnaA.FAD2.a introduced by TALE nuclease pair BnFAD2_T03
caggatccatgggtgcaggtggaagaatgcaagtgtctcctccccccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31145 - DNA, 348 bp, Artificial
  Mutation in BnaA.FAD2.a introduced by TALE nuclease pair BnFAD2_T03
caggatccatgggtgcaggtggaagaatgcaagtgtctcatccctccaagaagtctgaaaccgacaccatcaagcgcgtaccctgcgagacaccgcccttcacaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31146 - DNA, 350 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaaactcaagaaagcaatcacaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31147 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgccctttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31148 - DNA, 350 bp, Artificial
  Mutation in BnaA.FAD2.a introduced by TALE nuclease pair BnFAD2_T03
caggatccatgggtgcaggtggaagaatgcaagtgtctcccccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31149 - DNA, 282 bp, Artificial
  Mutation in BnaA.FAD2.a introduced by TALE nuclease pair BnFAD2_T03
caggatccatgggtgcaggaagaagaatgcaagtctatagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcatcgactac

SEQ ID NO: 31150 - DNA, 350 bp, Artificial
  Mutation in BnaA.FAD2.a introduced by TALE nuclease pair BnFAD2_T03
caggatccatgggtgcaggtggaagaatgcaagtgtctcatccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31151 - DNA, 347 bp, Artificial
  Mutation in BnaA.FAD2.a introduced by TALE nuclease pair BnFAD2_T03
caggatccatgggtgcaggtggaagaatgcaagtgtctcctccatccaaaaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31152 - DNA, 354 bp, Artificial
  Mutation in BnaA.FAD2.a introduced by TALE nuclease pair BnFAD2_T03
caggatccatgggtgcaggtgcaagaatgcaagtgtctcctccctccaaaaagtctgaaaccgacaacatcaagcgcgtaccctgcgagacaccgcccttcactgtcggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31153 - DNA, 345 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31154 - DNA, 350 bp, Artificial
  Mutation in BnaA.FAD2.a introduced by TALE nuclease pair BnFAD2_T03
caggatccatgggtgcaagtggaagaatgcaagtgtctcctccctccaaaaagtctgaaaccgacaacatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31155 - DNA, 350 bp, Artificial
  Mutation in BnaA.FAD2.a introduced by TALE nuclease pair BnFAD2_T03
caggatccatgggtgcaggtggaagaatgcaagtctctcctccctccagctcccccggaaccaacaccctcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31156 - DNA, 398 bp, Artificial
  Mutation in BnaA.FAD2.a introduced by TALE nuclease pair BnFAD2_T03
caggatccatgggtgcaggtggaagaatgcaagtgtcacatccctccaagaagtctgaaaccgacaacatcaagcccgtaccctgcgagacaccgcccttcactgtcgggcgactgccctgctgcgtaacatcgttgctgctccataacatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31157 - DNA, 305 bp, Artificial
  Mutation in BnaA.FAD2.a introduced by TALE nuclease pair BnFAD2_T03
caggatccatgggtgcaggtggaagaatgcaagtgtctcctccatccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcatcgactac

SEQ ID NO: 31158 - DNA, 345 bp, Artificial
  Mutation in BnaA.FAD2.a introduced by TALE nuclease pair BnFAD2_T03
caggatccatgggtgcaggtcgaagaatgcaagtgtctcctccctccaaaaagtctgaaaccgacaacatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31159 - DNA, 342 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31160 - DNA, 347 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31161 - DNA, 290 bp, Artificial
  Mutation in BnaA.FAD2.a introduced by TALE nuclease pair BnFAD2_T03
caggatccatgggtgcaggtggaagaatgcaagtctctcctctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31162 - DNA, 350 bp, Artificial
  Mutation in BnaA.FAD2.a introduced by TALE nuclease pair BnFAD2_T03
caggatccatgggtgcaggcggaagaatgcaagtgtctcctccctccaaaaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctggatcatagcccacgagtgcggccaccacgccttcagcgactac

SEQ ID NO: 31163 - DNA, 356 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccacccttcactctcggcggagacctcaagaaagcaatcccacctcactgcttcaaacgctccatccctcgctctttctcctacctcatcttggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31164 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgacta

SEQ ID NO: 31165 - DNA, 348 bp, Artificial
  Mutation in BnaA.FAD2.a introduced by TALE nuclease pair BnFAD2_T03
caggatccatgggcgcaggtggaagaatgcaagtgtttcctccctccaaaaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagcgtgcgtcctaaccggcttcttgttcatagcccacgagtgcggccacctcgccctcagcgactac

SEQ ID NO: 31166 - DNA, 419 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggcccacggcttgaccccccagcaggtggtggccatcgccagcactaatggtggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31167 - DNA, 349 bp, Artificial
  Mutation in BnaA.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaacgggcctctgggtcatcgcccacgaatgcggccaccacgccttcagcgactac

SEQ ID NO: 31168 - DNA, 349 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccccttacttccctctcctcccccaccctctcccttacctcgcctggcccctctactgggcctgccaaggctgcgtcctaacgggcctctgggtcatcgcccacgaatgcggccaccacgccttcatcgactac

SEQ ID NO: 31169 - DNA, 295 bp, Artificial
  Mutation in BnaA.FAD2.a introduced by TALE nuclease pair BnFAD2_T03
caggatccatgggtgcaggtggaagaatgcaagtgcctcctccctccaaaaagtctgaaaccgacaacatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 31170 - DNA, 351 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacatcaagcgcgtaccctgcgagacaccgcccttcactgtgagaactcaagaaagcaatcccaccgcactgtttcaaacgctcgatccctcgctatttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31171 - DNA, 344 bp, Artificial
  Mutation in BnaA.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtccttaccggcgtctgggtcatagcccacgagtgcggccaccacgccttcagcgactac

SEQ ID NO: 31172 - DNA, 345 bp, Artificial
  Mutation in BnaA.FAD2.a introduced by TALE nuclease pair BnFAD2_T03
caggatccatgggtgcagggggaagaatgcaagtgtctcctccttccaagaagtctgaaaccgacaccatcaagcgcgtaccctgcgcgacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcgcacgagtgctgccaccacgccttcagcgactac

SEQ ID NO: 31173 - DNA, 339 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31174 - DNA, 348 bp, Artificial
  Mutation in BnaA.FAD2.a introduced by TALE nuclease pair BnFAD2_T03
caggatccatgggtgcaggtggaagaatgcaagtgtctcctccctccaaaaagtctgaaaccgacaacctcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactac

SEQ ID NO: 31175 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 31176 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatccctcgctctttctcctacctcatcttggacatcatcatagcctcctgcttctactacgtcgccaccacttacttccctcccctccctcaccctctctcctgcttcgcctggcctctctactgggcctgccaagggtgcgtcctaaccggcgtctgggtcatagcccacgagtgcggccaccacgccttcagcgactac

SEQ ID NO: 31177 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31178 - DNA, 442 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggctgttgccggtgctgtgccaggcccacggcttgaccccggagcaggtggtggccatcgccagccacgatggcggcaacagccgctggacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31179 - DNA, 287 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31180 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31181 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31182 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31183 - DNA, 287 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31184 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31185 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31186 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31187 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 31188 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31189 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31190 - DNA, 351 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31191 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31192 - DNA, 413 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggatgggatccgatccaatgaagacaatcgacatagtgactggatatgttgtgttttacagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31193 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctcaagaaggcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31194 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctccttctcctcttcgacatcatcatctcctcctcggctcctccctctaccacctctccacagcctacttccctctcccttacctcgcctggcccctctactgggcctgccaaggctgcgtcctaacgggcctctgggtcatagcccacgagtgcggccaccacgccttcagcgactac

SEQ ID NO: 31195 - DNA, 317 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31196 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31197 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31198 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgttccctcgctctttctcctacctcatctggaacatcatcatagcctcctgcttctactacgtcgccaccacttacttccctctcctccctcaccctctctcctacttcgcctggcctctctacttggcctgccaagggtgcgtcctaaccggcgtctgggtcatagcccacgagtgcggccaccacgccttcagcgactac

SEQ ID NO: 31199 - DNA, 287 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31200 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31201 - DNA, 391 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacccgcttcctcgctcactgactcgctgcgctcggtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31202 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31203 - DNA, 352 bp, Artificial
  Mutation in BnaC.FAD2.a introduced by TALE nuclease pair BnFAD2_T03
caggatccatgggtgcaggtggaagaatacaagtgtctcctccctccaagaagtctgaaaccgacaccatcaagcgcgtaccctgcgagacaccgcccttcactgtggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31204 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 31205 - DNA, 317 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31206 - DNA, 351 bp, Artificial
  Mutation in BnaC.FAD2.a introduced by TALE nuclease pair BnFAD2_T03
caggatccatgggtgcaggtggaagaatgcaagtgtcgcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31207 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31208 - DNA, 370 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaagcaggccctggagacggaccccccgcgaaatctctcccgccccactgcttccaactctccatccctcgctcctgctcctacctcctcttcgacatcctcttctcctcctccctctaccacccctccaccgcctacttccctctccccccccaccctctctcctacttcgcctggcctctctactgggcctgccaagggtgcgtcctaaccggcgtctgggtcatagcccacgagtgcggccaccacgccttcagcgactac

SEQ ID NO: 31209 - DNA, 280 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31210 - DNA, 351 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31211 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 31212 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaatggtgcgtcctaaccggcgtctgggtcatagcccacgagtgcggccaccacgccttcagcgactac

SEQ ID NO: 31213 - DNA, 428 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtgctgtgccaggcccacggcttgaccccccagcaggtggtggccatcgccagcaataatggcggcaagcaggcggagaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31214 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31215 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacatcgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31216 - DNA, 385 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgaggcttgttgtgaagggattccaacaaaaagtaggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31217 - DNA, 350 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactctagaactcaagaaagcaatcccaccgcactgtttcaaacgatcgatccctcgctctttatcctacctcatctgggacatcatcatagcctcctgcttctactacgtcgccaccacttacttccctctcctcccccaccctctctcctacttcccctagcctctctactgggcctgccaagggtgcgtcctaaccgacgtcttggtcatagcccacgagtgcggccaccgcgccatcagcgactgc

SEQ ID NO: 31218 - DNA, 380 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcatctagatccaatgatcatgagcggagaattaaggagaactcaagaaagcaatcccaccgcactgtttcaaacgctcgatccctcgctctttctcctacctcatctgggacatcatcatagcctcctgcttctactacgtcgccaccacttactttcctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31219 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31220 - DNA, 389 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgatttcttgtcaaaaatgctccactgacgttccataaattcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggtctgccaagggtgcgtcctaaccggcgtctgggtcatagcccacgagtgcggccaccacgccttcagcgactac

SEQ ID NO: 31221 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31222 - DNA, 425 bp, Artificial
  Mutation in BnaC.FAD2.a introduced by TALE nuclease pair BnFAD2_T03
caggatccatgggtgcatgtggaagaatgcaagtgtctcctccctccaagaagtctgaaaccgacaccatcaagcgcgtaccctgcgagacaccgcccttcactgttagttcggttcgttcgacagtggcgcagcaccacgaggcactggtcggccacgggtttacacacgcgcacaagaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31223 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31224 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 31225 - DNA, 342 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31226 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 31227 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31228 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31229 - DNA, 338 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31230 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 31231 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatcgcccacgaatgcggccaccacgccttcagcgactac

SEQ ID NO: 31232 - DNA, 371 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcccaaccggcgtctgggtcatagcccacgaatgcggccaccacgccttcagcgactac

SEQ ID NO: 31233 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31234 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31235 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaagggtgcgtcctaaccggcgtctgggtcatagcccacgagtgcggccaccacgccttcagcgactac

SEQ ID NO: 31236 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31237 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 31238 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31239 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31240 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31241 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31242 - DNA, 342 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31243 - DNA, 306 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31244 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 31245 - DNA, 401 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgggccttgtagttgcccttgaagtggcaggacacgaacaggaacttgaactagaactcaagaaagcaatcccaccgcactgtttcaaacgctcgatccctcgctctttctcctacctcatctggtacatcatcatagcctcctgcttctactacgtcgccaccacttacttccctctcctccctcaccctctcgcctacttcgcctggcctctctactgggcctgccaagggtgcgtcctaaccggcgtctgggtcatagcccacgagtgcggccaccacgccttcagcgactac

SEQ ID NO: 31246 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31247 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31248 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgattgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31249 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagctactac

SEQ ID NO: 31250 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31251 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 31252 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgtgcctgccaagcgtgcgtcctaacgggcctctgggtcatagcccacgagtgcggccaccacgccttcagcgactac

SEQ ID NO: 31253 - DNA, 317 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccgcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31254 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctacagggcctgccaaggctgcgtcctaacgggcctctgggtcatagcccacgagtgcggccaccacgccttcagcgactac

SEQ ID NO: 31255 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 31256 - DNA, 342 bp, Artificial
  Mutation in BnaC.FAD2.a introduced by TALE nuclease pair BnFAD2_T03
caggatccatgggtgcaggtggaagaatgcaagtgtctcatccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31257 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31258 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactctcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31259 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacctgcgtctgggtcatagcccacgagtgcggccaccacgccttcagcgactac

SEQ ID NO: 31260 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31261 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31262 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31263 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31264 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtgctaaccggcgtctgggtcatagcccgcgagtgcggccaccacgccttcagcgactac

SEQ ID NO: 31265 - DNA, 350 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31266 - DNA, 339 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31267 - DNA, 413 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggccatcgccagcaatggcggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31268 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcacttagaactcaagaaagcaagcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgggcctgccaagggtgcgtcctaaccggcgtctgggtcatagcccacgagtgcggccaccacgccttcagcgactac

SEQ ID NO: 31269 - DNA, 265 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggacatcatcatagcctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31270 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31271 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctcttggtcatcgcccacgaatgcggccaccacgccttcagcgactac

SEQ ID NO: 31272 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaaccggcgtctgggtcatagcccacgagtgcggccaccacgccttcagcgactac

SEQ ID NO: 31273 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcgaactcaagaaagcaatcccaccgcacagtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31274 - DNA, 380 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcatctagatccaatgatcatgagcggagcattcaggagaactcaagaaagcaatcccaccgcactgtttcaaacgctcgatccctagctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31275 - DNA, 355 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31276 - DNA, 325 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcactgtttcaaacgctcgatccctcgctctttctccaacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31277 - DNA, 349 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31278 - DNA, 410 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggttcagcctggtcagctgggccttgtagttgcccttgaagtggccggacacgaacaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccaggagtgcggccaccacgccttcagcgactac

SEQ ID NO: 31279 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31280 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgtttcaaacgctcgatccctcgctctttctcctacctcatctgggacatcatcatagcctcctgcttctactacgttgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31281 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31282 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccaccattcactcacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31283 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31284 - DNA, 384 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcagactgagcctttcgttttatctgttgtttgtcggtgaacgctctcctgagtaggtcaaatccgctctgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31285 - DNA, 335 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagcgagacctcaagaaagcaatcccacctcactgcttcaaacgctccatccctcgctctttctcctacctcatctgggacatcatcatagcctcctgcttctactacgtcgccaccacttactaccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31286 - DNA, 283 bp, Artificial
  Mutation in BnaC.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31287 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31288 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctggcctctctactgggcctgccaagggtgcgtcctaaccggcgtctgggtcatagcccacgagtgcggccaccacgccttcagcgactac

SEQ ID NO: 31289 - DNA, 374 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttttgccagcgcctaatgcgccgggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 31290 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31291 - DNA, 357 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtccagcggctgttgccggagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31292 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31293 - DNA, 347 bp, Artificial
  Mutation in BnaC.FAD2.a introduced by TALE nuclease pair BnFAD2_T03
caggatccatgggtgcaggtggaataatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcccctctactgggcatgccaaggctgcgtcctaacgggcctctgggtcatagcccacgagtgcggccaccacgccttcagcgacac

SEQ ID NO: 31294 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31295 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccattaagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31296 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttttgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgac

SEQ ID NO: 31297 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctactccctcaccctctctcctacttcgcctggcctctctactgggcctgccaagggtgcgtcctaaccggcgtctgggtcatagcccacgagtgcggccaccacgccttcagcgactac

SEQ ID NO: 31298 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccaccgcactgtttcaaacgctcgatccctcgctctttctcctgcctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31299 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 31300 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctttactgggcctgctaagggtgcgtcctaaccggcgtctgggtcatagcccacgagtgcggccaccacgccttcagcgactac

SEQ ID NO: 31301 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31302 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 31303 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31304 - DNA, 430 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtattggtaggagttaatattacctaaaaagaaacataaggtaatcaagccgattcattttaagcggcctttcaagcaacaaaaatcacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31305 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgagtgcggccaccacgccttcagcgactac

SEQ ID NO: 31306 - DNA, 359 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31307 - DNA, 415 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcgatgggcaggttgtagccgccggagtaggccttggtgtccacgatcacgccgtagtcgatggggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31308 - DNA, 309 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31309 - DNA, 344 bp, Artificial
  Mutation in BnaC.FAD2.a introduced by TALE nuclease pair BnFAD2_T03
caggatccatgggtgaggtggaagaatgcaagtgtctcctccctccagctcccccggaaccaacaccctcaaacgcgtcccctgcgagacaccgcccttcagaactcaagaaagcaatcccaccgcactgtttcaaatgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31310 - DNA, 305 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31311 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31312 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31313 - DNA, 363 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaaaaactcttggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31314 - DNA, 399 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttgggggatcctatcagccgttcccagctggtgaagtccgagctggaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31315 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31316 - DNA, 350 bp, Artificial
  Mutation in BnaC.FAD2.a introduced by TALE nuclease pair BnFAD2_T03
caggatcaatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31317 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatagcccacgagtgcggccaccacgccttcagcgactac

SEQ ID NO: 31318 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31319 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 31320 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31321 - DNA, 326 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31322 - DNA, 308 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31323 - DNA, 290 bp, Artificial
  Mutation in BnaC.FAD2.a introduced by TALE nuclease pair BnFAD2_T03
caggatccatgggtgcaggtggaagaatgcaagtctctcctctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccgcgagtgcggccaccacgccttcagcgactac

SEQ ID NO: 31324 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31325 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggcctctctactgggcctgccaagggtgcgtcctaaccggcgtctgggtcatagcccacgagtgcggccaccacgccttcagcgactac

SEQ ID NO: 31326 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggatatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31327 - DNA, 342 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31328 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31329 - DNA, 280 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31330 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 31331 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagacgcctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31332 - DNA, 349 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31333 - DNA, 313 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 31334 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31335 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctatttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31336 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtacactgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccaagggtgcgtcctaaccggcgtctgggtcatagcccacgagtgcggccaccacgccttcagcgactac

SEQ ID NO: 31337 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcttcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31338 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31339 - DNA, 385 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgtcgggtcagggtgccggccttgatcatctcgccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatcgcccacgaatgcggccaccacgccttcagcgactac

SEQ ID NO: 31340 - DNA, 277 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgagacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31341 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccaagggtgcgtcctaaccggcgtctgggtcatagcccacgagtgcggccaccacgccttcagcgactac

SEQ ID NO: 31342 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcctctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31343 - DNA, 351 bp, Artificial
  Mutation in BnaC.FAD2.a introduced by TALE nuclease pair BnFAD2_T03
caggatccatgggtgcaggtggaagaatacaagtgtctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31344 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31345 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcataaccggcgtctgggtcatagcccacgagtgcggccaccacgccttcagcgactac

SEQ ID NO: 31346 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31347 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggggcatagcccacgagtccggccaccacgccgttagcgactac

SEQ ID NO: 31348 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctcgatccctcgctctttctcctacctcatctgggacatcatcatagcctcctgcttctactacgtcgccaccacttacttccctctcctccctcacactctctcctacttcgcctggcctctctactgggcctgccaaggctgcgtcctaacgggcctctgggtcatagcccacgagtgcggccaccacgccttcagcgactac

SEQ ID NO: 31349 - DNA, 325 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 31350 - DNA, 350 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31351 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctaccacctctccacagcctacttccctctcccttacctcgcctgacccctctactgggcctgccaaggctgcgtcctaacgggcctctgggtcatagcccacgagtgcggccaccacgccttcagcaactac

SEQ ID NO: 31352 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 31353 - DNA, 338 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31354 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31355 - DNA, 317 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcatccgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31356 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgagacctcaagaaagcaatcccacctcactgcttcaaacgctccatccctcgctccttctcctacctcctctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31357 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31358 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31359 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31360 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgacta

SEQ ID NO: 31361 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctccaaaaacacacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 31362 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccgcgagtgcggccaccacgccttcagcgactac

SEQ ID NO: 31363 - DNA, 469 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcagccgctggaccgtctccagcgcctgcttgccaccgccattgctggcgatggccaccacctgctggggggtcaagccgtgggcctggcacagcaccggcaacagccgctggagatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31364 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31365 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31366 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31367 - DNA, 370 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaatggcaagcaggcgctggagacggagaactcaagaaagcaatcccaccgcactgtttcaaacgctcgatccctcgctctttctcctacctcatctgggacatcagcatagcctcctgcttctactacgtcgccaccacttacttccctctcctccctcaccctctctcctgcttcgcctggcctctctactgggcctgccaagggtgcgtcctaaccggcgtctgggtcatagcccacgagtgcggccaccacgccttcagcgactac

SEQ ID NO: 31368 - DNA, 354 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgggaagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31369 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31370 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacacaatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31371 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31372 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31373 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcacactctatcctacttcgcctggcctctctactgggcctgccaagggtgcgtcctaaccggcgtctgggtcatagcccacgagtgcggccaccacgccttcagcgactac

SEQ ID NO: 31374 - DNA, 348 bp, Artificial
  Mutation in BnaC.FAD2.a introduced by TALE nuclease pair BnFAD2_T03
caggatccatgggagcaggtggaagaatgaaagtctctcctccctccagatcaccagaaaccaaaaccctcaaacgcgtcccctgcgagaaaccacccttcactctacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31375 - DNA, 349 bp, Artificial
  Mutation in BnaC.FAD2.a introduced by TALE nuclease pair BnFAD2_T03
caggatcctgggtgcaggtggaagaatgcaagtgtctcctccctccaagaagtctgaaaccgacaccatcaagcgcgtaccctgcgagacaccgaccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31376 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccattcactgtcggaactcaagaaagcaatcccaccgccctgtttcaaacgctcgatccctcgctctttctcctacctcatctgggacatcatcatagcctcctgcttctactacgtcgcctccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31377 - DNA, 348 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31378 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31379 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31380 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 31381 - DNA, 300 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 31382 - DNA, 280 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31383 - DNA, 279 bp, Artificial
  Mutation in BnaC.FAD2.a introduced by TALE nuclease pair BnFAD2_T03
caggatccatgggtgcaggtggaagaatgcaagtctctcctccctccagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31384 - DNA, 393 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctggtggtggccatcgccagcaatattggtggcaagcaggcgctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31385 - DNA, 344 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31386 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctcctgggcctgccaagggtgcgtcctaaccggcgtctgggtcatagcccacgagtgcggccaccacgccttcagcgactac

SEQ ID NO: 31387 - DNA, 427 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactttcggggtcaagccgtgggccatcgccagccacgatggcggcaagcaggcgctggagacggtccagcggctgttgccggagacctcaagaaagcaatcccacctcactgcttcaaacgctcgatccctcgctctttctcctacctcatctgggacatcatcatagcctcctgcttctactacgtcgccaccacttacttccctcccctccctcaccctctctcctacttcgcctggcctctctactgggcctgccaagggtgcgtcctaactggcgtctgggtcatagcccacgagtgcggccaccacgccttcagcgactac

SEQ ID NO: 31388 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31389 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaacccgacaccctcaagcgcgtaccctgcgagacaccgcccttcactgtagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 31390 - DNA, 308 bp, Artificial
  Mutation in BnaC.FAD2.a introduced by TALE nuclease pair BnFAD2_T03
caggatccatgggtgcaggtggaagaatgcaagtgtctcattccttcaaaaagtctgaaaccgacaccatcaagaaagcaatcacaccgcactgtttcaaacgctcgatacctcgccctttctcctacctcatctgggacatcatcatagcctcctgcttctactacgtcgccaccacttacttccctctcctccctcaccctcgctcctacttcgccaggcctctctactgggcctgccaaggatgcgtcctaaccggcgtcggggtcatagcccacaagtgctgccaccgcgccatcagcgactac

SEQ ID NO: 31391 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31392 - DNA, 388 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactcacccgtcagtgcattgcgccatgcatgcactgcctccagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31393 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31394 - DNA, 395 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctgagcctttcgttttatctgttgtttgtcggtgaacgctctcctgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcaggactac

SEQ ID NO: 31395 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggccggccaaggctgcgtcctaacgggcctctgggtcatagcccacgagtgcggccaccacgccttcagcgactac

SEQ ID NO: 31396 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31397 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31398 - DNA, 342 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 31399 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31400 - DNA, 349 bp, Artificial
  Mutation in BnaC.FAD2.a introduced by TALE nuclease pair BnFAD2_T03
caggatccatgggtgcaggtggaacaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctggttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31401 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccaccattcactctgcgttatcccctgattctgtggataaccgtattaccgagacctcaagaaagcaatcccacctcactgcttcaaacgctccatcccacgctccttctcctcttcgacatcatcatctcctcctcggctcctccctcaccctctctcctacttcgcctggcctctctactgggcctgccaaggctgcgtcctaacgggcctctgggtcatcgcccacgaatgcggccaccacgccttcagcgactac

SEQ ID NO: 31402 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccaccgcactgtttcaaactctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31403 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccaaaaccctcaagcgcgtaccctgcgagacaccgcccttcactgattgaaaaactcaagaaagcaatcccaccgcactgtttcaaacgctcaatccctccccctttcccctacctcaactggcacatcatcctagcctcctgcctctactacgtcgccaccacttacttccctctcctcccccaccctctctcttacctcgcctggcctctctactgggcctgccaagggtgcgtcctaacgggcgtctgggtcatagcccacgagtgcggccaccacgccttcagcgactac

SEQ ID NO: 31404 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 31405 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31406 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31407 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31408 - DNA, 317 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccctcagcgactac

SEQ ID NO: 31409 - DNA, 396 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggatggccttctgcttagtttgatgcctggcagtttatggcgggcatactcaagaaagcaatcccaccgcactgtttccaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31410 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31411 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31412 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 31413 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccgtcagcgactac

SEQ ID NO: 31414 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31415 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 31416 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31417 - DNA, 283 bp, Artificial
  Mutation in BnaC.FAD2.a introduced by TALE nuclease pair BnFAD2_T03
caggatccatgggtgcaggtggaagaatgcaagtgtatcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31418 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcgtgtgggtcatagcccacgagtgcggccaccacgccatcagcgactac

SEQ ID NO: 31419 - DNA, 338 bp, Artificial
  Mutation in BnaC.FAD2.a introduced by TALE nuclease pair BnFAD2_T03
ccaggatccatgggtgcaggtggaagaatgcaagtgtctcctccctccaagaagtctgaaaccgacaccatcaagcgcgtaccctgcgagacaccgcccttcactgtgagaactcaagaaagcaatcccacctcactgcttcaaacgctccatcccacgctccttctcctcttcgacatcatcatctcctcctcggctcctccctctaccacctctccacagcctacttccctctcccttacctcgcctggcctctctactgggcctgccaagggtgcgtcctaaccggcgtctgggtcatagcccacgagtgcggccaccacgccttcagcgactac

SEQ ID NO: 31420 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31421 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31422 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 31423 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31424 - DNA, 382 bp, Artificial
  Mutation in BnaC.FAD2.a introduced by TALE nuclease pair BnFAD2_T03
caggatccatgggtgcaggtggaagaatgcaagtgcctcctccctccaagaagtctgaaaccgacaccatcaagcgcgtaccctgcgagacaccgcccttcactgtgatagttgagtcgatacttcggcgatcaccgctgaactcaagaaagcaatcccaccgcactgtttcaaacgctcgatccctcgctctttctcctacctcatctgggacatcatcatagcctcctgcttctactacgtcgccaccacttacttccctctcccccctcaccctctctcctacttcgcctggcctctctactgggcctgccaaggctgcgtcctaacgggcctctgggtcatcgccctcgaatgcggccaccacgccttcagcgactac

SEQ ID NO: 31425 - DNA, 349 bp, Artificial
  Mutation in BnaC.FAD2.a introduced by TALE nuclease pair BnFAD2_T03
caggatccatgggtgcaggtggaacaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctggttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31426 - DNA, 342 bp, Artificial
  Mutation in BnaC.FAD2.a introduced by TALE nuclease pair BnFAD2_T03
catgatccatgggtgcaggtggaagaatgcaagtgtctcctccctccaagaagtctgaaaccgacaccatcaaacgcgtaccctgcgagacaccgcccttcactgtagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31427 - DNA, 349 bp, Artificial
  Mutation in BnaC.FAD2.a introduced by TALE nuclease pair BnFAD2_T03
caggatccatgggtgcaggtggaagaatgcaagtgtctcctccctacaagaagcctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgtgcctgccaagggtgcgtcctaaccgtcgtctgggtcatagcccacgagtgcggccaccacgccttcagcgactac

SEQ ID NO: 31428 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctacgagacaccacccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31429 - DNA, 314 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 31430 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 31431 - DNA, 327 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31432 - DNA, 411 bp, Artificial
  Mutation in BnaC.FAD2.a introduced by TALE nuclease pair BnFAD2_T03
caggatccatgggtgcaggtggaagaatgcaagtgactcctccctccaagaagtctgaaaccgacaccatcaagcgcgtaccctgcgagacaccaccattcactctcgccagccacgatggcggcaagcaggcgctggagacggtccagcggctgttgccggtgctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31433 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31434 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagccaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31435 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtcttaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31436 - DNA, 305 bp, Artificial
  Mutation in BnaC.FAD2.a introduced by TALE nuclease pair BnFAD2_T03
caggatccatgggtgcaggtggaagaatgcaagtgtctcctccctcccagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31437 - DNA, 330 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31438 - DNA, 352 bp, Artificial
  Mutation in BnaC.FAD2.a introduced by TALE nuclease pair BnFAD2_T03
caggatccattggtgcaggtggaagaatgcaagtctctcctccctccagctcccccgaaaccaaaaccctcaaacgcgtcccctgcgagacaccacccttcactctcgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31439 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctcggggtcatagcccacgagtgcggccaccacgccttcagcgactac

SEQ ID NO: 31440 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcttacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31441 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31442 - DNA, 396 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctctgagcctttcgttttatctgttgtttgtcggtgaacgctctcctgagacctcaagaaagcaatcccaccgcactgtttcaaacgctcgatccctcgctctttctcctacctcatctgggacatcatcatagcctcctgcttctactacgtcgccaccacttacttccctctcctccctcgccctctctcctacttcgcctggcctctctactgggcctgccaagggtgcgtcctaaccgacgtctgggtcatagcccacgagtgcggccaccacgccttcagcgactac

SEQ ID NO: 31443 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31444 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31445 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctcttctacttcgcctggcctctctactgggcctgccaagggtgcgtcctaaccggcgtctgggtcatagcccacgagtgcggccaccacgccttcagcgactac

SEQ ID NO: 31446 - DNA, 381 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgaggcatttctgtcctggctggtctagaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31447 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31448 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgttgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 31449 - DNA, 305 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgaactcaagaaagcaatcccaccgcactgtctcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31450 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcccaccgcactgtttcaaacgctcgatccctcgctctttctcctacctcatctgggacatcatcatagcctcctgcttctactacgtcgccacctcttacttccctctcctccctcaccctctctcctacttcgcctggcccctctactgggcctgccaagcctgcgtcctaacgggcctctgggtgatcgcccacgaatgcggccaccacgccttcagcgactac

SEQ ID NO: 31451 - DNA, 326 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctagccggcgtctgggtcatagcccacgattgcggccaccacgccttcagcgactac

SEQ ID NO: 31452 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctggatccctcgctctttctcctaccttatctgggacatcatcatagcctcctgcttctactacgtcgccaccacttacttccctctcctccctcaccctctctcctacttcgcctggcctctctactgggcctgccaagggtgcgtcctaaccggcgtctgggtcatatcccacgagtgcggccaccacgccttcagcgactac

SEQ ID NO: 31453 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgatcgatccctcgctctttctcctacctcatctgggacatcatcatagcctcctgcttctactacgtcgccaccacttacttccctctcctccctcaccctctctcctacttcgcctgtcctctctactgggcctgccaaggttgcgtcctcaccggcgtctgggtcatatcccacgagtgcggccaccacgccttcagcgactac

SEQ ID NO: 31454 - DNA, 345 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcgcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcatcgactac

SEQ ID NO: 31455 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgtgtcctaacgggcctctgggtcatagcccacgagtgcggccaccacgccttcagcgactac

SEQ ID NO: 31456 - DNA, 349 bp, Artificial
  Mutation in BnaC.FAD2.a introduced by TALE nuclease pair BnFAD2_T03
caggatccatgggtgcaggtggaacaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31457 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcttggtcatagcccacgagtgcggccaccacgccttcagcgactac

SEQ ID NO: 31458 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtcccctgcgagacaccacccttcactctccatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31459 - DNA, 287 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31460 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31461 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31462 - DNA, 338 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctccaaaaacacacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtgatagcccacgagtgcggcctccacgccttcagcgactac

SEQ ID NO: 31463 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31464 - DNA, 280 bp, Artificial
  Mutation in BnaC.FAD2.a introduced by TALE nuclease pair BnFAD2_T03
caggatccatgggtgcaggtggaagaatgcaagtgactcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31465 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgtctggcctctctactgggcctgccaagggtgcgtcctaaccggcgtctgggtcatagcccacgagtgcggccaccacgccttcagcgactac

SEQ ID NO: 31466 - DNA, 280 bp, Artificial
  Mutation in BnaC.FAD2.a introduced by TALE nuclease pair BnFAD2_T03
caggatccatgggtgcaggtggaagaatgcaagtgcctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31467 - DNA, 347 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcacttaactcaagaaagcaatcccaccgcactgttccaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31468 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcttctgggtcatagcccacgagtgcggccaccacgccttcagcgactac

SEQ ID NO: 31469 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttaacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31470 - DNA, 350 bp, Artificial
  Mutation in BnaC.FAD2.a introduced by TALE nuclease pair BnFAD2_T03
caggatccatgggtgcaggtggaagaatgcaagtgactcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 31471 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacacaatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31472 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31473 - DNA, 333 bp, Artificial
  Mutation in BnaC.FAD2.a introduced by TALE nuclease pair BnFAD2_T03
caggatccatgggtgcaggtggaagaatacaagtgtctcctccctccaagaagtctgaaaccgacaccatcaagcgcgtaccctgcgagacacctcaagaaagcaatcccaccgcactgtttcaaacgctcgatccctcgctctttctcctacctcatctgggacatcatcatagcctcctgcttctactacgtcgccaccacttactcccctctcctccctctccctctctcctacttcgcctggcctctctactgggcctgccaagggtgcgtcctaaccggcgtctgggtcatagcccacgagtgcggccaccacgccttcagcgactac

SEQ ID NO: 31474 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31475 - DNA, 340 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 31476 - DNA, 425 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagttcggttcgttcgacagtggcgcagcaccacgaggcactggtcggccacgggtttacacacgcgcacaagaaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31477 - DNA, 402 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtccagcgcctgcttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31478 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatctcaccgcactgtttcaaacgctcgatccctcgctctttctcctacctcatctgggacatcatcatagcctcctgcttctactacgtcgccaccacttacttccctctcttccctcaccctctctcctacttcgcctggcctctctactgggcctgccaaggctgtgtcctaacgggcctctgggtcatcgcccacgaatgcggccaccacgccttcagcgactac

SEQ ID NO: 31479 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgttccaaacgctcgatccctccctctttctcctcttcgaaatcatcacctcctcctcggctcctccctctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 31480 - DNA, 280 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31481 - DNA, 368 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagcaatggcggtggctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31482 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31483 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 31484 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaactcaagaaagcaatcccaccgcactgtttcaaacgctccatccctcgctctttctcctacctcatctgagacatcctcctagcctcctgcttctactacgtcgccacctcttacttccctctcctccctcaccctctctcctacttcgcctgccctctctactgggcctgccaaggctgcgtcctaaccggcgtctgtgtcatcgcccacgaatgcggccaccactccttcagcgactac

SEQ ID NO: 31485 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31486 - DNA, 351 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 31487 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31488 - DNA, 430 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtattggtaggagttaatattacctaaaaagaaacataaggtaatcaagccgattcattttaagcggcctttcaagcaacaaaaatcacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31489 - DNA, 318 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaacgctcgatccctcgctctttcttctacctcatctgggacatcatcatagcctcctgcttctactacgtcgccaccacttacttccctctcctccctcaccctctctcctacttcgcctggcctctctactgggcctgccaagggtgcgtccgaaccggcgtctgggtcatagcccacgagtgcggccaccacgccttcagcgactac

SEQ ID NO: 31490 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccaagggtgcttcctaacgggcctctgggtcatcgcccacgaatgcggccaccacgccttcagcgactac

SEQ ID NO: 31491 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 31492 - DNA, 351 bp, Artificial
  Mutation in BnaC.FAD2.a introduced by TALE nuclease pair BnFAD2_T03
caggatccatgggtgcaggtgcaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31493 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31494 - DNA, 371 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttttgacggggtcagtgccttaagtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31495 - DNA, 280 bp, Artificial
  Mutation in BnaC.FAD2.a introduced by TALE nuclease pair BnFAD2_T03
caggatccatgggtgcaggtggaagaatgcaagtgtatcctccctcccagaagtctgaaaccgacaccatcaagcgcgtaccctgcgagccaccgcccttcactgtcgggacatcatcatagcctcctgcttctactacgtcgccaccacttacttccctctcctccctcaccctctctcctacttcgcctggcctctctactgggcctgccaagggtgcgtcttaaccggcgtcggggtcatagcccacgagtgcggccaccacgccttcagcgactac

SEQ ID NO: 31496 - DNA, 351 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31497 - DNA, 360 bp, Artificial
  Mutation in BnaC.FAD2.a introduced by TALE nuclease pair BnFAD2_T03
caggatccatgggtgcaggtggaagaatgcaagtgcctcctccctccagctcccccggaaccaacaccctcaaacgcgtcccctgcgagacaccaccattcactccatcccacgctccttctcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccaagggtgcgtcctaaccggcgtctgggtcatagcccacgagtgcggccaccacgccttcagcgactac

SEQ ID NO: 31498 - DNA, 388 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaacgcccttcactcacccgtcagtgcattgcgccatgcatgcactgcctccagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31499 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31500 - DNA, 280 bp, Artificial
  Mutation in BnaC.FAD2.a introduced by TALE nuclease pair BnFAD2_T03
caggatccatgggtgcaggtggaagaatgcaagtctcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31501 - DNA, 319 bp, Artificial
  Mutation in BnaC.FAD2.a introduced by TALE nuclease pair BnFAD2_T03
caggatccatgggtgcaggtggaagaatgtaagtgtctcctccctccaagaagtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31502 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaagtctgaaaccgacaacatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31503 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgattgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctagcctctctactgggcctgccagggatgcgtcctaaccggcgtcggggtcatagcccacgagtgcggccaccacgccatcagcgactac

SEQ ID NO: 31504 - DNA, 359 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcgccagaactcaagaaagcaatcccaccgcactgttccaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31505 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcgtctgggtcatagcccacgagtgcggccaccacgccttcagcgactac

SEQ ID NO: 31506 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31507 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggggcatagcccacgagtgcggccaccacgccttcagcgactac

SEQ ID NO: 31508 - DNA, 454 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaccgtctccagcgcctgcttgccaccattattgctggcgatggccaccacctgctccggggtcaagccgtgggcctggcacagcaccggcaacaggcgctggagaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31509 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 31510 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 31511 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccctcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31512 - DNA, 350 bp, Artificial
  Mutation in BnaC.FAD2.a introduced by TALE nuclease pair BnFAD2_T03
caggatccatgggtgcaggtggaagaatgcaagtgcctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31513 - DNA, 349 bp, Artificial
  Mutation in BnaC.FAD2.a introduced by TALE nuclease pair BnFAD2_T03
caggatccatgggtgcaggtgcaagaatgcaagtctctcctccctcccgctcccccggaaccaacaccctcaaacgcgtcccctgcgagacaccaccattcacggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31514 - DNA, 326 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31515 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 31516 - DNA, 382 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagcgccatctcgaaccgacgttgctggccgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31517 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31518 - DNA, 414 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcggcttgaccccccagcaggtggtggccatcgccagccacgatggcggcaacagccgctggaccagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaacgggcgtctgggtcatagcccacgagtgcggccaccacgccttcagcgactac

SEQ ID NO: 31519 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccccgagtgcggccaccacgccctcagcgactac

SEQ ID NO: 31520 - DNA, 432 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgacacacgaagcgatcgttggcgtcggcaaacaggtggaaataatatggattgggataaataatatggctgtttattttgtaactggcaagaaagcaatcccaccgtactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31521 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcctctctactgggcctgccaaggctgcgtcctaacgggcctctgggtcatcgcccacgaatgcggccaccacgccttcagcgactac

SEQ ID NO: 31522 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31523 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31524 - DNA, 346 bp, Artificial
  Mutation in BnaC.FAD2.a introduced by TALE nuclease pair BnFAD2_T03
caggatccatgggtgcatgtggaagaatgcaagtctctcctccctccagctcccccggaaccaacaccctcaaacgcgtcccctgcgagacaccaccattcactacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31525 - DNA, 343 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31526 - DNA, 325 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31527 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgttagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccactagtgcggccaccacgccttcagcgactac

SEQ ID NO: 31528 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31529 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31530 - DNA, 438 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttcgttggtcaacgcggccaacgccggatcagggcgagataactggacaacaatgctctccagcgcctgttgccggtgctgtgccaggccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcataccccacgagtgcggccaccacgccttcagcgactac

SEQ ID NO: 31531 - DNA, 353 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcagaactcaagaaagcaatcccaccgcactgtttcaaacgctcgatctctcgctctttctcctacctcatctgggacatcatcatagcctcctgcttctactacgtcgccaccacttacttccctctcctccctcaccctctctcctccttcgcctggcctctctactgggcctgccaagggtgcgtcctaaccggcgtctgggtcatagcccacgagtgcggccaccacgccccttcagcgactac

SEQ ID NO: 31532 - DNA, 369 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtacggtggtttgtttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 31533 - DNA, 385 bp, Artificial
  Mutation in BnaC.FAD2.a introduced by TALE nuclease pair BnFAD2_T03
caggatccatgggtgcaggtagaagaatgcaagtgtatcctccctccaaaaagtctgaaaccgacaccatcaagcgcgtaccctgcgagacaccgcccttcactgtcgggtcagggtgccggccttgatcatctcgccgccagaactcaagaaagcaatcccaccgcactgtttcaaacgctcgatccctcgctctttctcctacctcatctgggacatcatcatagcctcctgcttctactacgtcgccaccacttacgtccctctccgccctcaccctctctcctacttcgcctggcctctctactgggcctgccaagggtgcgtcctaaccggcgtctgggtcatagcccacgagtgcggccaccacgccttcatcgactac

SEQ ID NO: 31534 - DNA, 338 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctccaaaaacacacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31535 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 31536 - DNA, 349 bp, Artificial
  Mutation in BnaC.FAD2.a introduced by TALE nuclease pair BnFAD2_T03
caggatccatgtgtgcaggtggaagaatgcaagtgtctcctccctccaaaaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31537 - DNA, 314 bp, Artificial
  Mutation in BnaC.FAD2.a introduced by TALE nuclease pair BnFAD2_T03
caggatccatgggtgcaggtggaagaatgcaagtgtctcctccatccaaaaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31538 - DNA, 410 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctacaggcccacggcttgaccccccagcaggtggtggccatcgccagcaataatggaggcggagacctcaagaaagcaatcccaccgcactgtttcaaacgctcgatccctcgctctttcccctacctcatctgggacatcatcatggccgcctgcttctacgacgacgccaccacttacttccctctccacccacaccctctctcctacgtcgcctggcctctctactgggccggcgaaggctgcgtccgaacgggccactgggtcatagcccacgagtgcggccaccacgccatcaacgactgc

SEQ ID NO: 31539 - DNA, 338 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31540 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31541 - DNA, 428 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtgctgtgccaggcccacggcttgaccccccagcaggtggtggccatcgccagcaataatggcggcaagcaggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacaagtgcggccaccacgccttcagcgactac

SEQ ID NO: 31542 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcggccaccacgccttcagcgactac

SEQ ID NO: 31543 - DNA, 344 bp, Artificial
  Mutation in BnaC.FAD2.a introduced by TALE nuclease pair BnFAD2_T03
caggatccatgggtgcaggtgcaagaatgcaagtgtatccacccccccgctcccccggaaccaacacactcaaacgagtcccctgcgagacaccaccatagcctttctagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcttcctaaccggcttcggggtcatagcccacgagtgcggccacgacgcctttgtcgactac

SEQ ID NO: 31544 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcttggtcatagcccacgagtgcggccaccacgccttcagcgactac

SEQ ID NO: 31545 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaagcctgcgtcctaacgggcctctgggtcatagcccacgagtgcggccaccacgccttcagcgactac

SEQ ID NO: 31546 - DNA, 415 bp, Artificial
  Mutation in BnaC.FAD2.a introduced by TALE nuclease pair BnFAD2_T03
caggatccatgggtgcaggtggcagaatgcaagtctctcctcactccagctcccccggaaccaacaccctcaaacgcgtcccctgcgagacaccaccattcactctcggagacggtccagcggctgttgcccgtgctgtgccaggcccacggtccagcgcctgcttgccggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccacctcgccttcagcgactac

SEQ ID NO: 31547 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcataagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31548 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaactcaagagagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccacaacgccttcagcgactac

SEQ ID NO: 31549 - DNA, 349 bp, Artificial
  Mutation in BnaC.FAD2.a introduced by TALE nuclease pair BnFAD2_T03
caggatccatgggtgcaggtggaagaatgcaagtctatcctccctccagctcccccgaaaccaaaaccctcaaacgcgtcccctgcgagccaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccggcctctctactgggcctgccaagggtgcgtccgaaccggcgtctgggtcatagcccacgagtgctgccaccacgccttcagcgactac

SEQ ID NO: 31550 - DNA, 341 bp, Artificial
  Mutation in BnaC.FAD2.a introduced by TALE nuclease pair BnFAD2_T03
caggatccatgggtgcaggtggaagaatgcaagtctatcctccctcccgctcccccggaaccaacaccctcaaacgcgtcccctgcgagacaccaccattcactagacctcaagaaagcaatcccaccgcactgtttcaaacgctcgatcccacgctccttctcctcttcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31551 - DNA, 354 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcgggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31552 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31553 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31554 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtacccccagcaggtggtgaccatcgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31555 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtcggggtcatagcccacgagtgcggccaccacgccttcagcgactac

SEQ ID NO: 31556 - DNA, 326 bp, Artificial
  Mutation in BnaC.FAD2.a introduced by TALE nuclease pair BnFAD2_T03
caggatccattggtgcaggtggaagaatgcaagtctctcctccctccaagaagtctgaaaccgacaccatcaagcgcgtaccctgcgagacaccgcccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31557 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31558 - DNA, 347 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctggacatcatcatagcctcctgcttctactacggcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31559 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctggggcatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31560 - DNA, 410 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggttcagcctggtcagctgggccttgtagttgcccttgaagtggccggacacgaacaggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgggcctgccaagggtgcgtcctaaccggcgtctgggtcatagcccacgagtgcggccaccacgccttcagcgactac

SEQ ID NO: 31561 - DNA, 368 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagcaatggcggtggctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31562 - DNA, 349 bp, Artificial
  Mutation in BnaC.FAD2.a introduced by TALE nuclease pair BnFAD2_T03
caggatccatgggtgcaggtggcagaatgcaagtgtctcctacctcaaaaaagtctgaaaccgacaccatcaagcgcgtaccctgcgcgacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcgtcctaaccggcatctgggtcatagcccacgagtgcggccaccacgccttcagcgactac

SEQ ID NO: 31563 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31564 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggaactcaagaaagcaatcccaccgcactgtttcaaacgctcgatccctcgctctttctcctacctcatctgggacatcatcatagcctcctgcttctactacgtcgccaccacttaattccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31565 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtcccctgcgagacaccgcccttcactgagaactcaagaaagcaatcccaccgcactgtttcaaacgcgcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31566 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31567 - DNA, 348 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcacaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31568 - DNA, 349 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcgtccaccacgccttcagcgactac

SEQ ID NO: 31569 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacctcatcatagcctcctgcttctactacgtcgccaccacttacttccctctcctccctcaccctctctcctgcttcgcctggcctctctactgggcccgccaagggtgcgtcctaaccggcgtctgggtcatagcccacgagtgcggccaccacgccttcagcgactac

SEQ ID NO: 31570 - DNA, 349 bp, Artificial
  Mutation in BnaC.FAD2.a introduced by TALE nuclease pair BnFAD2_T03
caggatccatgggtgcaggtggaagaatgcaagtgtatactccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagggcggccaccacgccatcagcgactac

SEQ ID NO: 31571 - DNA, 442 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttcgccagccacgatggcggcaagcaggcgctggagacggtccagcggctgttgccggtgctgtgccaggcccacggcttgaccccccagcagagaactcaagaaagcaatcccaccgcactgtttcaaacgctcgatccctcgctctttctcctacctcatctgggacatcatcatagcctcctgcttctactacgtcgccaacacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31572 - DNA, 337 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31573 - DNA, 335 bp, Artificial
  Mutation in BnaC.FAD2.a introduced by TALE nuclease pair BnFAD2_T03
caggatccatgggtgcaggtggcagaatgcaagtgtctactccctcaaagaagtctgaaaccgacaccatcaagcgcgtaccctgcgagacaccgcccttcactgagaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31574 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31575 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31576 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31577 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaatggtgcgtcctaaccggcgtctgggtcatagcccacgagtgcggccaccacgccttcagcgactac

SEQ ID NO: 31578 - DNA, 347 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtactcaagcaagcaatcccaccgcactgtttcaaacgctcgatccctcgctctttctcctacctcatctgggccatcatcatagcctcctgcttctactacgtcgccaccacttacttccctctcctccctcaccctctcccctacttcgcctggcctctctactgggcctgccaagggtgcgtcctaaccggcgtctgggtcatagcccacgagtgcggccaccacgccttcagcgactac

SEQ ID NO: 31579 - DNA, 349 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatttcgcctggcctctctactgggcctgccaagggtgcgtcctaaccggcgtctgggtcatagcccacgagtgcggccaccacgccttcagcgactac

SEQ ID NO: 31580 - DNA, 349 bp, Artificial
  Mutation in BnaC.FAD2.a introduced by TALE nuclease pair BnFAD2_T03
caggatccatgggtgcaggcggaagaatgcatgtatctcctcaaaccagctccaccgaaaccaaaaccatcaaacgcgtcccctgcgagacaccacccttcactcagacctcaagaaagcaatcccacctcactgcttcaaacgctccatccctcgctctttctcctacctcatctgggacatcatcatagcctcctgctactactacgtcgccaccacttacttccctctcctccctcaccctctctcctacttcgcctggcctctctactgggcctgccaagggtgcgtcctaacaggcgtctgggtcatagcccacgagtgcggccaccacgccttcagcgactac

SEQ ID NO: 31581 - DNA, 411 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaggtcttgaccccggagcaggtggtggccatcgccagccacgatggcggcaagcaggcgctggagaagaactcaagaaagcaatcccaccgcactgtttcaaacgctcgatccctcgctctttctcctacctcatctgggacatcatcatagcctcctgcttctactacgtcgccaccacttacttccctctcctccctcaccctttctcctacttcgcctggcctctctactgggcctgccaagggtgcgtcctaaccggcgtctgggtcatagcccacgagtgcggccaccacgccttcagcgactac

SEQ ID NO: 31582 - DNA, 382 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgagcgccatctcgaaccgacgttgctggccgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31583 - DNA, 352 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31584 - DNA, 406 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactggctggcgatggccaccacctgctggggggtcaagccgtgggcctggcacagcaccggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctacggggcctgccaaggctgcgtcctaacgggcctctgggtcatcgcccacgaatgcggccaccacgccttcagcgactac

SEQ ID NO: 31585 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31586 - DNA, 406 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggctggggactgccgccacctgttggggggtcaagccgtgggcctggcacagcaccggagaactcaagaaagcaatcccaccgcactgtttcaaacgctcgatccctcgctcttactcctacctcatctgggacatcatcatagcctcctgcttctactacgtcgccaccacttacttccctctcctccctcaccctctctcctacttcgcctggcccctctactgggcctgccaagggtgcgtcctaaccggcgtctgggtcatagcccacgagtgcggccaccacgccttcagcgactac

SEQ ID NO: 31587 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctcaagaaatcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31588 - DNA, 349 bp, Artificial
  Mutation in BnaC.FAD2.a introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgctgccaccacgcctgcagcgactac

SEQ ID NO: 31589 - DNA, 347 bp, Artificial
  Mutation in BnaC.FAD2.a introduced by TALE nuclease pair BnFAD2_T03
caggatccatgggtgcaggtggcagaatgcaagtctctcctccctccagctcccccgaaaccaaaaccctcaaacgcgtcccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31590 - DNA, 342 bp, Artificial
  Mutation in BnaC.FAD2.a introduced by TALE nuclease pair BnFAD2_T03
caggatccatgggtgcaggtggaagaatgcaagtctctcctccctccaacaagcccgaaaccgacaccatcaagcgcgtaccctgcgagacaccacccttcactcaagaaagcaaccccaccgcactgcttccaacgctcgatcactcgctctttctcctacctcacctcgcacatcatcataccttcctgcttctactacgtcgccaccccctacttcactcccttccctcaccctctctcctacttcgcctggcccctctactgggcctgccaaggctgcgtcctaaccggcgtctgggtcatagcccacgagtgcggccaccacgccttcagcgactac

SEQ ID NO: 31591 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgtcaagggtgcgtcctaaccggcgtctgggtcatagcccacgagtgcggccaccacgccttcagcgactac

SEQ ID NO: 31592 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31593 - DNA, 349 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31594 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaaccggcgtctgggtcatagcccacgagtgcggccaccacgccttcagcgactac

SEQ ID NO: 31595 - DNA, 349 bp, Artificial
  Mutation in BnaC.FAD2.a introduced by TALE nuclease pair BnFAD2_T03
caggatccatgggtgcaggtggaagaatgcaagtgtctcatccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31596 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcacttacctcgcctggcccctctactgggcctgccaaggctgcgtcctaacgggcctctgggtcatagcccacgagtgcggccaccacgccttcagcgactac

SEQ ID NO: 31597 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31598 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccatgagtgcggccaccacgccttcagcgactac

SEQ ID NO: 31599 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31600 - DNA, 344 bp, Artificial
  Mutation in BnaC.FAD2.a introduced by TALE nuclease pair BnFAD2_T03
caggatccatgggtgcaggtggcagaatgcaagtctctcctccctccagctcccccgaaaccaaaaccctcaaacgcgtcccctgcgagacaccacccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31601 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactcacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31602 - DNA, 409 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaggcccacggcttgaccccggagcaggtggtggccatcgccagcaatattggtggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31603 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcacgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31604 - DNA, 349 bp, Artificial
  Mutation in BnaC.FAD2.a introduced by TALE nuclease pair BnFAD2_T03
cagaatccatgggtgcaggtggaagaatgcaagtctctcctccctccagctcccccgaaaccaaaaccctcaaacgcgtcccctgcgagacaccacccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31605 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31606 - DNA, 454 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaccgtctccagcgcctgcttgccaccattattgctggcgatggccaccacctgctccggggtcaagccgtgggcctggcacagcaccggcaacaggcgctggagaagaactcaagaaagcaatcccaccgcactgtttcaaacgctcgatccctcgctctttctcctccctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31607 - DNA, 344 bp, Artificial
  Mutation in BnaC.FAD2.a introduced by TALE nuclease pair BnFAD2_T03
caggatccatgggtgcaggtggcagaatgcaagtgtctcatccctccaagaagtctgaaaccgacaccatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtccgaaccggcgtcggggtcatagcccacgagtgcggccaccacgccttcagcgactac

SEQ ID NO: 31608 - DNA, 442 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgtccagcggctgttgccggtgctgtgccaggcccacggcttgaccccggagcaggtggtggccatcgccagccacgatggcggcaagcaggcgcgggagagagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccttccaagggtgcgtcctaaccggcgtctgggtcatagcccacgagtgcggccaccacgccttcagcgactac

SEQ ID NO: 31609 - DNA, 442 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccgtccagcggctgttgccggtgctgtgccaggcccacggcttgaccccggagcaggtggtggccatcgccagccacgatggcggcaagcaggcgctggagagagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccttccaagggtgcgtcctaaccggcgtctgggtcatagcccacgagtgcggccaccacgccttcagcgactac

SEQ ID NO: 31610 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctggaacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31611 - DNA, 402 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggggtcaagccgtgggcctggcacagcaccggcaagcaggcgctggagacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31612 - DNA, 406 bp, Artificial
  Mutation in BnaC.FAD2.a introduced by TALE nuclease pair BnFAD2_T03
caggatccatgggtgcaggtggtagaatgcaagtgtatactccctccaagaagtctgaaaccgacaccatcaagcgcgtaccctgcgagacaccgcccttcactgtcgccgtcgggcttcctggagccgcccgatttagagcttgacggggaaagccggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31613 - DNA, 348 bp, Artificial
  Mutation in BnaC.FAD2.a introduced by TALE nuclease pair BnFAD2_T03
caggatccatgggtgcaggtggcagaatgcaagtctctcctccctccagctcccccggaaccaacaccctcaaacgcgtcccctgcgagacaccaccattcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31614 - DNA, 317 bp, Artificial
  Mutation in BnaC.FAD2.a introduced by TALE nuclease pair BnFAD2_T03
caggatccatgggtgcagggggcagaatgcaagtgtctaccccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgtgtgcggccaccacgcctgcagcgactac

SEQ ID NO: 31615 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31616 - DNA, 349 bp, Artificial
  Mutation in BnaC.FAD2.a introduced by TALE nuclease pair BnFAD2_T03
caggatccatgggtgcaggtcgaacaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctggttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31617 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31618 - DNA, 350 bp, Artificial
  Mutation in BnaC.FAD2.a introduced by TALE nuclease pair BnFAD2_T03
caggatccatgggtgcaggtagaagaatgcaagtgtatcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31619 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31620 - DNA, 348 bp, Artificial
  Mutation in BnaC.FAD2.a introduced by TALE nuclease pair BnFAD2_T03
cagatccagggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31621 - DNA, 408 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggacttcgctgctacccaaggttgccgggtgacgcacaccgtggaaacggatgaaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31622 - DNA, 369 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacggtggtttgtttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31623 - DNA, 350 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31624 - DNA, 336 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31625 - DNA, 351 bp, Artificial
  Mutation in BnaC.FAD2.a introduced by TALE nuclease pair BnFAD2_T03
caggatccatgggtgcaggtagaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttcccactcctccctcaccctctctcctacttcgcctggcctctctactgggcctgccaagggtgcgtcctaacgggcctctgggtcatagcccacgagtgcggccaccacgccttcagcgactac

SEQ ID NO: 31626 - DNA, 368 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagcaatggcggtggctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31627 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 31628 - DNA, 338 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 31629 - DNA, 350 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31630 - DNA, 349 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31631 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagacgtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31632 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 31633 - DNA, 304 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 31634 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31635 - DNA, 319 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31636 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcggagacctcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 31637 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaaactcaagaaagcaatcccaccgcactgtttcaaacgctcgatccctcgctctttctcctacctcatctgggacatcatcatagcctcctgcttctactacgacgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31638 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31639 - DNA, 354 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31640 - DNA, 374 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgttttgccagcgcctaatgcgccgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31641 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactctcagaactcaagagagcaatcccaccgcactgtttcaaacgctcgatccctcgctctttctcccacctcatctgggacatcatcatagcctcctgcttctactacctcgccccctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31642 - DNA, 415 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcccacggcttgaccccggagcaggtggtggccatcgccagccacgatggcggcaacagccgctggaagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31643 - DNA, 409 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaggcccacggcttgaccccggagcaggtggtggccatcgccagcaatattggtggcgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31644 - DNA, 350 bp, Artificial
  Mutation in BnaC.FAD2.a introduced by TALE nuclease pair BnFAD2_T03
caggatccatgggtgcaggtggcagaatgcaagtctctcctccctccagctcccccgaaaccaaaaccctcaaacgcgtcccctgcgagacaccaccactcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31645 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcatgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31646 - DNA, 348 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtaactcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31647 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtcccctgcgagacaccgcccttcactgaagaactcaagaaagcaatcccaccgccctgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31648 - DNA, 350 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31649 - DNA, 277 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgagacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31650 - DNA, 350 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31651 - DNA, 460 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacgtctccagcggctgttgccggtgctgtgccaggcccacggcttgaccccccagcaggtggtggccatcgccagcaatggcggtggcaagcaggcgctggagacggtccagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcgtctgggtcatagcccacgagtgcggccaccacgccttcagcgactac

SEQ ID NO: 31652 - DNA, 385 bp, Artificial
  Mutation in BnaC.FAD2.a introduced by TALE nuclease pair BnFAD2_T03
caggatccatgggtgcaggtggaagaatgcaagtgtctactccctccaaaaagtctgaaaccgacaccatcaagcgcgtaccctgcgagacaccgcccttcactgtcgggtcagggtgccggccttgatcatctcgccgccagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 31653 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccattaagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgagtcatcgcccacgaatgcggccaccacgccttcagcgactac

SEQ ID NO: 31654 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31655 - DNA, 343 bp, Artificial
  Mutation in BnaC.FAD2.a introduced by TALE nuclease pair BnFAD2_T03
caggatccatgggtgcaggtggcagaatgcaagtctctcctccctccagctcccccggaaccaacaccctcaaacgcgtcccctgcgagacaccgcccttcactgtaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31656 - DNA, 356 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31657 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcataaccggcgtctgggtcatagcccacgagtgcggccaccacgccttcagcgactac

SEQ ID NO: 31658 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcgcgactac

SEQ ID NO: 31659 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31660 - DNA, 324 bp, Artificial
  Mutation in BnaC.FAD2.a introduced by TALE nuclease pair BnFAD2_T03
caggatccatgggtgcaggtcgaagaatgcaagtgtctcatccctccaagaagtctgaacccgacaccatcaagcgcgtaccctgcgagacaccgccgggtacgcgctttatgggacatcatcatagcctcctctttctcctacctcatctgggacatcatcatagcctcctgcttctactacgtcgccaccacttacttccctctcctccctcaccctctctcctacttcgcctggcctctctactggtcctgccaggggtgcgtccttaccggcgtctgggtcatagccctcgagtgcggccaccacgccttcagcgactac

SEQ ID NO: 31661 - DNA, 348 bp, Artificial
  Mutation in BnaC.FAD2.a introduced by TALE nuclease pair BnFAD2_T03
caggatccatgggtgcaggtggaagaatgcaagtgtctactccctccaaaaagtctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccaagggtgcggcctaaccggcgtcggggtcatagcccacgagtgcggccaccacgccatcagcgactac

SEQ ID NO: 31662 - DNA, 350 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcgtccaccacgccttcagcgactac

SEQ ID NO: 31663 - DNA, 340 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtacggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31664 - DNA, 282 bp, Artificial
  Mutation in BnaC.FAD2.a introduced by TALE nuclease pair BnFAD2_T03
caggatccagggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31665 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31666 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31667 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccaccacgccttcagcgactac

SEQ ID NO: 31668 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31669 - DNA, 456 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcggcggctgttgccggtgctgtgccaggcccacggcttgaccccggagcaggtggtggccatcgccagcaatattggtggcaagcaggcgctggagacggtgcaggagaactcaagaaagcaatcccaccgcactgtttcaaatgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31670 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 31671 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctaccaagggtgcgtcctaaccggcgtctgggtcatagcccacgagtgcggccaccacgccttcagcgactac

SEQ ID NO: 31672 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 31673 - DNA, 381 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttcggggcatttctgtcctggctggtctagaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacttcgcctggcctctctactgggcctgccaagggtgcgtcctaaccggcgtctgggtcatagcccacgagtgcggccaccacgccttcagcgactac

SEQ ID NO: 31674 - DNA, 349 bp, Artificial
  Mutation in BnaC.FAD2.a introduced by TALE nuclease pair BnFAD2_T03
caggatccatgggtgcaggtggaagaatgcaagtctctcctccctccagcttccccggaaccaacaccctcaaacgcgtcccctgcgagacaccacccttcactcagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31675 - DNA, 348 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31676 - DNA, 317 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 31677 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31678 - DNA, 345 bp, Artificial
  Mutation in BnaC.FAD2.a introduced by TALE nuclease pair BnFAD2_T03
caggatccatgggtgcacgtggaagaatgcaagtgtctcctccctccaagaagtctgaaaccgacaccatcaagcgcgtaccctgcgagacaccgcccttcactgtacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31679 - DNA, 347 bp, Artificial
  Mutation in BnaC.FAD2.a introduced by TALE nuclease pair BnFAD2_T03
cagatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31680 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31681 - DNA, 326 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31682 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagctactac

SEQ ID NO: 31683 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31684 - DNA, 345 bp, Artificial
  Mutation in BnaC.FAD2.a introduced by TALE nuclease pair BnFAD2_T03
aaggatccatgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31685 - DNA, 328 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31686 - DNA, 348 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctacggggcctgccaagggtgcgtcctaacgggcctcgggggcatagcccacgagtgcggccaccacgccatcagcgactac

SEQ ID NO: 31687 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcattatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31688 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 31689 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccaagggtgcggcctaaccggcgtcggggtcatagcccacgagtgcggccaccacgccttcagcgactac

SEQ ID NO: 31690 - DNA, 372 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31691 - DNA, 319 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccacccttcactgtttcaaacgctcgatccctcgctctttcttctacctcatctgggacatcatcatagcctcctgcttctactacgtcgccaccacttacttccctctcctccctcaccctctctcctacttcgcctggcctctttactgggcctgccaagggtgcgtcctaaccggcgtctgggtcatagcccacgagtgcggccaccacgccttcagcgactac

SEQ ID NO: 31692 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 31693 - DNA, 308 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31694 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31695 - DNA, 277 bp, Artificial
  Mutation in BnaC.FAD2.a introduced by TALE nuclease pair BnFAD2_T03
caggatccatgggtgcaggtggaagaatgcaagtgtctcctccctccaaaaagcctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31696 - DNA, 346 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31697 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccaccgcactgtttcaaacgctcgatccctcgctctttctcctaccacatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31698 - DNA, 421 bp, Artificial
  Mutation in BnaC.FAD2.a introduced by TALE nuclease pair BnFAD2_T03
caggatccatgggtgcaggtcgaagaatgcaagtgtctcctccctccaagaagtctgaaaccgacaccatcaagcgcgtaccctgcgagacaccgcccttcactatttgatgcctggcagttccctactctcgccagcaataatggtggcaagcaggcgctggatacggtccagcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31699 - DNA, 350 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31700 - DNA, 413 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgccgctggaccgtctccagcgcctgcttgccaccattattgctggcgatggccactacctgcttaactcaagaaagcaatcccaccgcactgtttcaaacgctcgatccctcgctctttctcctacctcatctgggacatcatcatagcctcctgcttctactacgtcgccaccccttacttccctctcctcccgcaccctctctcctacttcgcctggcctctctactgggcctgccaagggtgcgtcctaaccggcgtctgggtcatagcccacgagtgcggccaccacgccttcagcgactac

SEQ ID NO: 31701 - DNA, 347 bp, Artificial
  Mutation in BnaC.FAD2.a introduced by TALE nuclease pair BnFAD2_T03
caggatccatgggtgcaggtggtagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 31702 - DNA, 386 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgccagccacgatagcggcaacagccgctggaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31703 - DNA, 343 bp, Artificial
  Mutation in BnaC.FAD2.a introduced by TALE nuclease pair BnFAD2_T03
cagtatccatgggtgcaggtggaagaatgcaagtgtctcctccctccaagaagtctgaaaccgacaccatcaagcgcgtaccctgcgagacaccgcccttcactgtaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31704 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31705 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctccggcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31706 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagcccgaaaccgacaccatcaagcgcgtaccctgcgagacaccgcccttcactgtagaactccagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcccctctactgggcctgccaagggtgcgtcctaaccggcgtctgggtcatagcccacgagtgcggccaccacgccttcagcgactac

SEQ ID NO: 31707 - DNA, 347 bp, Artificial
  Mutation in BnaC.FAD2.a introduced by TALE nuclease pair BnFAD2_T03
caggatccatgggtgaggtggaagaatgcaagtctctcctccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31708 - DNA, 405 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcaacagccgctggaccgtctccagcgcctgcttgccaccattattgctggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31709 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31710 - DNA, 371 bp, Artificial
  Mutation in BnaC.FAD2.a introduced by TALE nuclease pair BnFAD2_T03
caggatccatgggtgcaggtggaagaatgcaagtctctcctccctacagctccaccgaaaccaaaatactcaaacgcgtcccctgcgagacaccacccttcactctcgccggtgctgtgccaggcccagacctcaagaaagcaatcccaccgcactgtttcaaacgctcgatccctcgctctttctcctacctcatctgggacatcatcatagcctcctgcttctactacgtcgccaccacttactttcctctcctccctcaccctctctcctccttcgcctggcctctctactgggccggccaatggtgcgtcctaaccggcgtctgggtcatagcccacgattgcggccaccacgccttcagcgactac

SEQ ID NO: 31711 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctacaagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31712 - DNA, 459 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcttgccctgacgagaaacaccagaacgggtagtgaattgcgcttgagatggtttaatttcaactttaatcattgtgaattaccttatgcgattttaagaactggcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31713 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccatgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31714 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31715 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagccacctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31716 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgactcaagaaagcaatcccaccgcactgtttcaaacgctcaatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31717 - DNA, 350 bp, Artificial
  Mutation in BnaC.FAD2.a introduced by TALE nuclease pair BnFAD2_T03
caggatccatgggtgcagggggaagaatgcaagtgtatccacactccaagaagtctgaaaccgacaccatcaagcgcgtaccctgcgagacaccgcccttcactggagaactcaagaaagcaatcccaccgcactgtttcaaacgctcgatgcctcgctctttctcctacctcatctggcacatcatcatagcctcctgcttctactacgtcgccaccacttacttccctctcctccctcaccctctctcctacttcgcctggcctctctcctgggcctgccaagggtgcgtcctaacgggcctctgggtcatcgcccacgaatgcggccaccacgccttcagcgactac

SEQ ID NO: 31718 - DNA, 309 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 31719 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31720 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccattcactctgagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgttcctgccaagcctgcgtcctaacgtgcctctgggtcatcgaaaaagaatgcggccaccacgaattaagcgactaa

SEQ ID NO: 31721 - DNA, 335 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31722 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 31723 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31724 - DNA, 338 bp, Artificial
  Mutation in BnaC.FAD2.a introduced by TALE nuclease pair BnFAD2_T03
caggatccatgggtgcaggtggaagaatgcaagtgtctcctccctccaaaaagcctgaaaccgacaccctcaagcgcgtaccctccaaaaacacacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31725 - DNA, 374 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttttgccagcgcctaatgcgccgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31726 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31727 - DNA, 345 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31728 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgactcaagaaagcaatctcaccgcactgtttcaaacgctcgatccctcgctctttctcctacctcatctgggacatcatcatagcctcctgcttctactacgtcgccaccacttacttccctctcctccctcaccctctctcctacttcgcctagcctctctactgcacctgccaagggtgcgtcctaaccggcgtctgggtcatagcccacgagtgcggccaccacgccttcagcgactac

SEQ ID NO: 31729 - DNA, 347 bp, Artificial
  Mutation in BnaC.FAD2.a introduced by TALE nuclease pair BnFAD2_T03
caggatccatggtgcaggtggaagaatgcaagtctctcctccatccagctcccccggaaccaacaccctcaaacgcgtcccctgcgagacaccaccattcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31730 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagtactctgaaaccaacaccatcaagcgcgtaccctgcgagacaccgcccttcactgtttcaaacgctcgatccctcgctctttctcccacctcatctgggacatcatcatagcctcctgcttctactacgtcgccaccacttacttccctctcctccctaaccctctctcctacttcgcctggcctctctactgggcctgccaagggtgcgtcctaaccggcgtctgggtcatagcccacgagtgcggccaccacgccttcagcgactac

SEQ ID NO: 31731 - DNA, 357 bp, Artificial
  Mutation in BnaC.FAD2.a introduced by TALE nuclease pair BnFAD2_T03
caggatccatgggtgcaggtggaagaatgcaagtatctcctccctccagctcccccggaaccaacaccctcaaacgcgtcccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgattgcggccaccacgccttcaccgactac

SEQ ID NO: 31732 - DNA, 338 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31733 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccgtcgctctttctcctacctcatctgggacatcatcatagcctcctgcttctactacgtcgccaccacttacttccctctcctccctcaccctctctccttcttcgcctggcctctctactgggcctgccaagggtgcgtcctaaccggcgtctgggtcatagcccacgagtgcggccaccacgccatcagcgactac

SEQ ID NO: 31734 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 31735 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgccctaaccggcgtctgggtcatagcccacgagtgcggccaccacgccttcagcgactac

SEQ ID NO: 31736 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 31737 - DNA, 348 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcgtctgggtcatagcccacgagtgcggccaccacgccttcagcgactac

SEQ ID NO: 31738 - DNA, 399 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactctcggcccacggcttgaccccccagcaggtggtggccatcgccagcaatggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31739 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgcccccactcacttccctctcctccctcaccctctctcctacttcgcctggcctctctactgggcctgccaagggtgcgtcctaaccggcgtctgggtcatagcccacgagtgcggccaccacgcctgcagcgactac

SEQ ID NO: 31740 - DNA, 346 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccatcaaacgcgtcccctgcgagacaccaccattcactaactcaagaaaacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31741 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccaccgcactgcttcaaacgctcgatccctcgctctttctcctacctcatccgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31742 - DNA, 316 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31743 - DNA, 351 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31744 - DNA, 350 bp, Artificial
  Mutation in BnaC.FAD2.a introduced by TALE nuclease pair BnFAD2_T03
caggatccatgggtgcaggtggaagaatgcaagtttatcctcactccagctcccccggaaccaacacaatcaaacgcgtcccctgcgagacaccgcccttcactgtaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccacctcgccttcagcgactac

SEQ ID NO: 31745 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatatcccacgagtgcggccaccacgccttcagcgactac

SEQ ID NO: 31746 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgtccaccacgccttcagcgactac

SEQ ID NO: 31747 - DNA, 317 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggggcgtcctacccggcgtctgggccataccccccgattgcggccaccccgcctccagcgactac

SEQ ID NO: 31748 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31749 - DNA, 332 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctaccacatctgggacatcatcatagcctcctgcttctactacgtcgccaccacttacttccctctcccttacctcgcctgacccctctactgggcctgccaaggctgcgtcctaacggacctctgggtcatagcccacgagtgcggccaccacgccttcagcgactac

SEQ ID NO: 31750 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31751 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaagggtgcgtcctaaccggcgtctgggtcatagcccacgagtgcggccaccacgccttcagcgactac

SEQ ID NO: 31752 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31753 - DNA, 349 bp, Artificial
  Mutation in BnaC.FAD2.a introduced by TALE nuclease pair BnFAD2_T03
caggatccatgggtgcaggtggaagaatgcaagtctctcctccctccaaaaagtctgaaaccgacaccatcaagcgcgtaccctgcgagacaccgcccttcactgagaactcaaggaagcaatcccaccgcactgtttcaaacgctcgatccctcgctctttctcctacctcctcttcgacatcctcgtctcctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31754 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31755 - DNA, 423 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctctccagcggctgttgccggtgctgtgccaggcccacggcttgaccccccagcaggtggtggccatcgccagcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31756 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 31757 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31758 - DNA, 337 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31759 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31760 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaactcaagaaagcaatcccaccgcactgtttcaaacgctcgatccctcgctctttctcctacctcatctgggacatcatcatagcctcctgcttctaccacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31761 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagactgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactggtcctgccaaggctgcgtcctaactggcctctgggtcatcgcccacgaatgcggccaccacgccttcagcgactac

SEQ ID NO: 31762 - DNA, 316 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31763 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatatcccgcgagtgcggccaccacgccttcagcgactac

SEQ ID NO: 31764 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31765 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccccgagtgcggccaccacgccttcagcgactac

SEQ ID NO: 31766 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccactagtgcggccaccacgccttcagcaactac

SEQ ID NO: 31767 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcgtcctaaccggcgtctgggtcatagcccacgagtgcggccaccacgccttcagcgactac

SEQ ID NO: 31768 - DNA, 401 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtgggccttgtagttgcccttgaagtggccggacacgaacaggaacttgaactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtaatagcccacgagtgcggccaccacgccttcagcgactac

SEQ ID NO: 31769 - DNA, 341 bp, Artificial
  Mutation in BnaC.FAD2.a introduced by TALE nuclease pair BnFAD2_T03
caggatccatgggtgcaggtggaagaatgcaagtgactcctccctccaagaagtctgaaaccgacaccatcaagcgcgtaccctgcgagacaccgcccttcactaagaaagcaatcccaccgcactgtttcaaacgctcgatccctcgctctttctcctacctcatctgggacatcatcatagcctcctgcttctactacgtcgccaccacttacttccctctactccctcaccctctctcctacttcgcctggcctctctactgggcctgccaagggtgcgtcctaaccggcgtctgggtcatagcccacgagtgcggccaccacgccttcagcgactac

SEQ ID NO: 31770 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacgccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31771 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactcc

SEQ ID NO: 31772 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctcgatccctcactctttcttctacctcatctgggacatcatcatagcctcctgcttctactacgtcgccaccacttacttccctctcctccctcaccctctctcctacttcgcctggcctctttactgggcctgctaagggtgcgtcctaaccggcgtctgggtcatagcccacgagtgcggccaccacgccttcagcgactac

SEQ ID NO: 31773 - DNA, 348 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactac

SEQ ID NO: 31774 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31775 - DNA, 295 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31776 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 31777 - DNA, 416 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgcccacggcttgaccccggagcaggtggtggccatcgccagccacgatggcggcaagcaggcgctggaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31778 - DNA, 349 bp, Artificial
  Mutation in BnaC.FAD2.a introduced by TALE nuclease pair BnFAD2_T03
caggatccatgggtgcagggggaagaatgcaagtctctcctccctccagctcccccggaaccaacaccctcaaacgcgtcccctgcgagacaccaccattcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatatcccacgagtgcggccaccacgccttcagcgactac

SEQ ID NO: 31779 - DNA, 319 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31780 - DNA, 339 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31781 - DNA, 398 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggcgactgccctgctgcgtaacatcgttgctgctccataacatcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31782 - DNA, 348 bp, Artificial
  Mutation in BnaC.FAD2.a introduced by TALE nuclease pair BnFAD2_T03
caggatccatgggtgcaggtgcaagaatgcaagtgtctcctccctccaagaagtctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31783 - DNA, 319 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31784 - DNA, 324 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 31785 - DNA, 410 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgactcaagacgatagttaccggataaggcgcagcggtcgggctgaacggggggtcgaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31786 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcttagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31787 - DNA, 283 bp, Artificial
  Mutation in BnaC.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31788 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtacgtcctaaccggcgtctgggtcatagcccacgagtgcggccaccacgccttcagcgactac

SEQ ID NO: 31789 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31790 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgattgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaaccggcgtctgggtcatagcccacgagtgcggccaccacgccttcagcgactac

SEQ ID NO: 31791 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctcgatccctcgctatttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31792 - DNA, 339 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31793 - DNA, 351 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgagaactcaagaaagcaatcccaccgcactgtttcaaacgctcgatccctcgctctttctcctacctcatatgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31794 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 31795 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31796 - DNA, 378 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacttttggagcagcaacgatgttacgcaccaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcggccaccacgccttcagcgactac

SEQ ID NO: 31797 - DNA, 406 bp, Artificial
  Mutation in BnaC.FAD2.a introduced by TALE nuclease pair BnFAD2_T03
cagatccatgggtgcaggtggaagaatgcaagtgtctcctccctccaagaagtctgaaaccgacaccatcaagcgcgtaccctgcgagacaccgcccttcactgtcgtggacaccaaggcctactccggcggctacaacctgcccatcggccaggccgacgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31798 - DNA, 349 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31799 - DNA, 371 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttttgacggggtcagtgccttaagtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31800 - DNA, 350 bp, Artificial
  Mutation in BnaC.FAD2.a introduced by TALE nuclease pair BnFAD2_T03
caggatgcatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgacta

SEQ ID NO: 31801 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31802 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccaccattcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31803 - DNA, 347 bp, Artificial
  Mutation in BnaC.FAD2.a introduced by TALE nuclease pair BnFAD2_T03
caggatccatgggtgcaggtggaagaatgcaagtgcctactccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31804 - DNA, 413 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggatgggatccgatccaatgaagacaatcgacatagtgactggatatgttgtgttttacagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 31805 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactctcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 31806 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31807 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31808 - DNA, 341 bp, Artificial
  Mutation in BnaC.FAD2.a introduced by TALE nuclease pair BnFAD2_T03
caggatccatgggtgcaggtggcagaatgcaagtgtctcctcactcaaagaagtctgaaaccgacaccatcaagcgcgtaccctgcgagacaccgcccttcactgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctatactgggcctgccaagggtgcgtcctaaccggcgtctgggtcatagcccacgagtgcggccaccacgccttaagcgactac

SEQ ID NO: 31809 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccacccttcactctagacctcaagaaaacaaccccacctcactgcttcaaccgcaccatccctcgctccttctcctacctcatctggtacatcatcatagcctcctgcttctactacgtcgccaccacccacttccctcccctccctcaccctctctcctacctcgcctggcctctctactgggcctgccaagggtgcgtcctaaccggcgtctgggtcatagcccacgagtgcggccaccacgccttcagcgactac

SEQ ID NO: 31810 - DNA, 348 bp, Artificial
  Mutation in BnaC.FAD2.a introduced by TALE nuclease pair BnFAD2_T03
caggatccatgggtgcaggtggaagaatgcaagtcactcctccctccaagaagcctgaaaccgacaccatcaagcgcgtaccctgcgagacaccgcccttcactataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgtcgcctggcctctctactgggtctgccaagggggcgtcctaaccggcgtctgggtcatagcccacgattgcggccaccacgccatcagcgactac

SEQ ID NO: 31811 - DNA, 351 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31812 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaagggtgcgtcctaaccggcgtctgggtcatagcccacgagtgcggccaccacgccttcagcgactac

SEQ ID NO: 31813 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31814 - DNA, 448 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacacccaccacagcaccgttcaccagtagcaccattaccattagcaaggccggaaacgtcaccaatgaaaccgtcgatagcagcaccgtaatcagtagcgacagaatcaagtttgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31815 - DNA, 336 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaagggtgcgtcctaaccggcgtctgggtcatagcccacgagtgcggccaccacgccttcagcgactac

SEQ ID NO: 31816 - DNA, 308 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31817 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccaagggtgcgtcctaaccggcgtctgggtcatagcccacgagtgcggccaccacgccttcagcgactac

SEQ ID NO: 31818 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31819 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31820 - DNA, 280 bp, Artificial
  Mutation in BnaC.FAD2.a introduced by TALE nuclease pair BnFAD2_T03
caggatccatgggtgcaggtgcaagaatgaaagtgtcgcctgagtccaagaagtctgaaaccgacaccatcaagcgcgtacccggcgagacaccgcccttcactgtcgggacatcatcatagcctcctgcttctactacgtcgccaccacttacttccctctcctccctcaccctctctcctacttcgcctggcctctctactgggcctgccaaggctgcgtcctaacggtcctctgggtcatcgcccacgaatgcggccaccaccccagcagcgactac

SEQ ID NO: 31821 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtagaactcaagaaagcaatcccaccgcactgtttcaaacgctcgatccctcgctatttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31822 - DNA, 430 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgctgtgcctggcccacggcttgaccccccagcaggcggtggccatcgccagcaatggcggtggcaagcaggcgctggagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31823 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31824 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccgcgagtgcggccaccacgccttcagcgactac

SEQ ID NO: 31825 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31826 - DNA, 348 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31827 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggtctgccaagggtgcgtcctaaccggcgtctgggtcatagcccacgagtgcggccaccacgccttcagcgactac

SEQ ID NO: 31828 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatgccaccgcactgtttcaaacgctcgattcctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 31829 - DNA, 350 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctagcctgcgtctgggtcatagcccgcgagtgcggccaccacgccgtcagcgactac

SEQ ID NO: 31830 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggtcatagcccacgagtgcggccaccacgccttcagcgactac

SEQ ID NO: 31831 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31832 - DNA, 283 bp, Artificial
  Mutation in BnaC.FAD2.a introduced by TALE nuclease pair BnFAD2_T03
caggatccatgggtgcaggtggaagaatgcaagtgtctcctccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagccctccattgcggccaccacgccttcagcgactac

SEQ ID NO: 31833 - DNA, 349 bp, Artificial
  Mutation in BnaC.FAD2.a introduced by TALE nuclease pair BnFAD2_T03
caggatccatgggtgcaggtggaagaatgcaagtgtctcctccctacaagaagtctgaaaccgacaccatcaagcgcgtaccctgcgagacaccgcccttcactgtagactcaagaaagcaatcccaccgcactgtttcaaacgcccgatccctcgctctttctcctacctcatctgggacatcatcatagcctcctgcttctactacgtcgccaccacttacttccctcccctccctcaccctctctcctacttcgcctggcctctctactgggcctgccaagggtgcgtcctaaccggcgtctgggtcatagcccacgagtgcggccaccacgccttcagcgactac

SEQ ID NO: 31834 - DNA, 336 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31835 - DNA, 349 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtcaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggccggccaagggtgcgtcctaacgggcctctgggtcatcgcccacgagtgcggccaccacgccatcagcgactac

SEQ ID NO: 31836 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31837 - DNA, 395 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggtggccatcgccagcaatggcggtggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31838 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcctctgggtcatagcccacgagtgcggccatcacgccttcagcgactac

SEQ ID NO: 31839 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31840 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactggttcaaacgctcgatccctcgctcttgctcctacctcatctgggacatcctcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31841 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31842 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcataatagcctcctgcttctactacgtcgccaccacttacttccctctcctccctcaccctctctcctacttcgcctggcctctctactgggcctgccaagggtgcgtcctaaccggcgtctgggtcatatcccacgagtgcggccaccacgccttcagcgactac

SEQ ID NO: 31843 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcacgactac

SEQ ID NO: 31844 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccattaagccacgatggcggcaagcaggcgctgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31845 - DNA, 356 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtcgacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31846 - DNA, 348 bp, Artificial
  Mutation in BnaC.FAD2.a introduced by TALE nuclease pair BnFAD2_T03
caggatccatgggtgcaggtggaagaatgcaagtctctcatccctccagctcccccgaaaccaaaaccctcaaacgcgtcccctgcgagacaccacccttcactcgacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31847 - DNA, 370 bp, Artificial
  Mutation in BnaC.FAD2.a introduced by TALE nuclease pair BnFAD2_T03
caggatccatgggtgcaggtggaagaatgtaagtctctacttacttcagctcccccggaaccaacactctcaaacgcgtcccctgcgagacaccgcccttcactgtcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctcctgggcctgccaagggcgcgtcctaacgggcctctgggtcatagcccacgagtgcggcccccccgccttcagcgcctac

SEQ ID NO: 31848 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 31849 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgcctggcccctctactgggcctgccaaggctgcgtcctaacgggcctctgggtcatcgcccacgaatgcggccaccacgccttcagcgactac

SEQ ID NO: 31850 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31851 - DNA, 402 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgtccggccacttcaagggcaactacaaggcccagctgaccaggctgaaccacatcaccaactgcggagaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 31852 - DNA, 370 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcaatggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccgagggtgcgtcctaaccggcgtctgggtcatagcccacgagtgcggccaccacgccttcagcgactac

SEQ ID NO: 31853 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31854 - DNA, 401 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgggccttgtagttgcccttgaagtggccggacacgaacaggaacttgaactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31855 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaacgcgtcccctgcgagacaccacccttcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31856 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcctggcctctctactgggcctgccaagggtgcgtcctaaccggcgtctgggtcatagcccacgagtgcggccaccacgccttcagcgactac

SEQ ID NO: 31857 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 31858 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31859 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctggcccctctactgggcctgccaaggctgcgtcctaacgggcctctgggtcatcgcccacgaatgcggccaccacgccttcagcgactac

SEQ ID NO: 31860 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacgaactcaagaaagcaatcccaccgcactgtttcaaacgcgcgatccctcgctctttctcctacctcatctgggacatcatcatagcctcctgcttctactacgtcgccaccacttacttccctctcctccctcaccctctctcctacttcgcctggcctctctacggggcctgccaagggtgcgtcctaaccggcgtctgggtcatagcccacgagtgcggccaccacgccttcagcgactac

SEQ ID NO: 31861 - DNA, 346 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31862 - DNA, 346 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31863 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31864 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagactgaaaccgacaacatcaagcgcgtaccctgcgagacaccgcccttcactgtcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgcctggcctctctactgggcctgccaagggtgcgtcctaaccggcgtctgggtcatagcccacgagtgcggccaccacgccttcagcgactac

SEQ ID NO: 31865 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31866 - DNA, 350 bp, Artificial
  Mutation in BnaC.FAD2.a introduced by TALE nuclease pair BnFAD2_T03
caggatccatgggtgcaggtggaagaatgcaagtatctcctccctccagctcccccgaaaccaaaaccctcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31867 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccatccttcactctgacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31868 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaactggcgtctgggtcatagcccacgagtgcggccaccacgccttcagcgactac

SEQ ID NO: 31869 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgacac

SEQ ID NO: 31870 - DNA, 389 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgatttcttgtcaaaaatgctccactgacgttccataaattcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31871 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctggcctctctactgggcctgccaatggtgcgtcctaaccggcgtctgggtcatagcccacgagtgcggccaccacgccttcagcgactac

SEQ ID NO: 31872 - DNA, 348 bp, Artificial
  Mutation in BnaC.FAD2.a introduced by TALE nuclease pair BnFAD2_T03
caggatccatggtcaggtggaagaatgcaagtctctcctccctccagctcccccgaaaccaaaaccctcaaacgcgtcccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31873 - DNA, 343 bp, Artificial
  Mutation in BnaC.FAD2.a introduced by TALE nuclease pair BnFAD2_T03
caggatccatgggtgcaggtggaagaatgcaagtgtctccttcctccaagaagtctgaaaccgacaccatcaagcgcgtaccctgcgagacaccgcccttcactcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31874 - DNA, 287 bp, Artificial
  Mutation in BnaC.FAD2.a introduced by TALE nuclease pair BnFAD2_T03
caggatccatgggtgcaggcggaagaatgcaagtgtctcctccctccaagaagtctgaaaccgacaccatcaagcgcgtaccctgcgagacacagcccttctcctacctcatctggaacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31875 - DNA, 319 bp, Artificial
  Mutation in BnaC.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31876 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccacaacgccttcagcgactac

SEQ ID NO: 31877 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccagcgtctgggtcatagcccacgagtgcggccaccacgccttcagcgactac

SEQ ID NO: 31878 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaactcaagaaagcaatcccaccgcactgtttcaaacgctcgatccctcgctctttctcctacctcatctgggacaccatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31879 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcattgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgccaacgaatgcggccaccacgccttcagcgactac

SEQ ID NO: 31880 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgtgtcatagcccacgagtgcggccaccacgccttcagcgactac

SEQ ID NO: 31881 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 31882 - DNA, 347 bp, Artificial
  Mutation in BnaC.FAD2.a introduced by TALE nuclease pair BnFAD2_T03
caggatccatgggtgcaggtggaagaatgcaagtgcctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31883 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagaaaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31884 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 31885 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacctggcctctctactgggcctgccaagggtgcgtcctaaccggcgtctgggtcatagcccacgagtgcggccaccacgccttcagcgactac

SEQ ID NO: 31886 - DNA, 338 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccgtcgtctgggtcatagcccacgagtgcggccaccacgccttcagcgactac

SEQ ID NO: 31887 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31888 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaagaaagcaatcccaccgcactgtttcagacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 31889 - DNA, 406 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctccagcgcctgcttgccaccattattgctggcgatggccaccacctgctggggggtcaagttgagcggggcacccgtcagtgcattgcgccagagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31890 - DNA, 354 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgggagaactcaagaaagcaatcccaccgcactgtttcaaacgctcgatccctcgctccttctcctacctcctcttcgacctcctcgtctcctcctccctctaccacctctccacagcctacttccctctcctcccccaccctctcccttacctcgcctggcccctctactgggcctgccaagggtgcgtcctaaccggcgtctgggtcatagcccacgagtgcggccaccacgcctgcagcgactac

SEQ ID NO: 31891 - DNA, 352 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 31892 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaacgcgtaccctgcgagacaccgcccttcactttgctccaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31893 - DNA, 411 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcctggcacagcaccggcaacagccgctggaccgtctccagcgcctgcttgccaccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31894 - DNA, 279 bp, Artificial
  Mutation in BnaC.FAD2.a introduced by TALE nuclease pair BnFAD2_T03
caggatccatgggtgcaggtggaagaatgcaagtctctcctccctccagtctctccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31895 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttagcgactac

SEQ ID NO: 31896 - DNA, 417 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgttgtccggccacttcaagggcaactacaaggcccagctgaccaggctgaaccacatcaccaactgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31897 - DNA, 316 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaactcaagaaagcaatcccaccgcactgtttcaaacgctcgatccctcgctctttctcctacctcatatgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31898 - DNA, 332 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31899 - DNA, 343 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaacatcaagcgcgtaccctgcgagacaccgcccttcactgtttggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31900 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31901 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccagcgtctgggtcatagcccacgagtgcggccaccacgccttcagcgactac

SEQ ID NO: 31902 - DNA, 435 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcatcctcacctcctccagggtcagggtgccggcctttggtggcaagcaggcgctggagacggtccagcggctgttgccggtgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31903 - DNA, 357 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaacatcaagcgcgtaccctgcgagacaccgcccttcactgtcgttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31904 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaaccggcgtctgggtcatagcccacgagtgcggccaccacgccttcagcgactac

SEQ ID NO: 31905 - DNA, 350 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaacctcaaacgcgtaccctgcgagacaccaccattcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgcctggcctctctactgggcctgccaagggtgcgtcctaaccggcgtctgggtcatagcccacgagtgcggccaccacgccttcagcgactac

SEQ ID NO: 31906 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctttactgggcctgctaagggtgcgtcctaaccggcgtctgggtcatagcccacgagtgcggccaccacgccttcagcgactac

SEQ ID NO: 31907 - DNA, 287 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacacagcccttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31908 - DNA, 318 bp, Artificial
  Mutation in BnaC.FAD2.a introduced by TALE nuclease pair BnFAD2_T03
caggatccatgggtgcaggtggaagaatgcaagtctctactccctccagctcccccgaaaccaaaaccctcaaacgcgtcccctgcgagacaccgcccttcactgtttcaaacgctcgatccctcgctctttctcctacctcatctgggacatcatcatagcctcctgcttctactacgtcgccaccacttacttccctctcctccctcaccctctcccctacctcgcctgacccctctactgggcctgccaaggctgcgtcctaacgggcctctgggtcatagcccacgagtgcggccaccacgccttcagcgacta

SEQ ID NO: 31909 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31910 - DNA, 348 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31911 - DNA, 349 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttcgcctggcctctctactgggcctgccaagggtgcggccgaaccggcgtctgggtcatagctcacgagtgcggccaccacgccatcaacgactac

SEQ ID NO: 31912 - DNA, 337 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgtcagaactcaagaaagcaatcccaccgcactgtttcaaacgctcgatccctcgctctttctcctcttcgacctcatcatctcctcctcggctcctccctctaccacctctccacagcctacttccctctcccttacctcgcctgacccctctactgggcctgccaaggctgcgtcctaaccggcgtctgggtcatagcccacgaatgcggccaccacgccttcagcgactac

SEQ ID NO: 31913 - DNA, 342 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31914 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31915 - DNA, 351 bp, Artificial
  Mutation in BnaC.FAD2.a introduced by TALE nuclease pair BnFAD2_T03
caggatccatgggtgcaggcggaagaatgcaagtctctcctccatccagctccaccgaaaccaaaaccctcaaacgcggcccctgcgagacaccacccttcactctcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacaagtgcggccaccacgccatcagcgactac

SEQ ID NO: 31916 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccgacgtctgggtcatagcccacgagtgcggccaccacgccttcagcgactac

SEQ ID NO: 31917 - DNA, 356 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31918 - DNA, 470 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggtgctgtgccaggcccacggcttgaccccccagcaggaggcggcatcccccagtaatgccgggggcaagccggggccggagacgcagccaccggcaacaggttccaggccacgccttaagacctcaagaaagcaaacccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31919 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31920 - DNA, 348 bp, Artificial
  Mutation in BnaC.FAD2.a introduced by TALE nuclease pair BnFAD2_T03
caggatccatggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctccatcccacgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31921 - DNA, 279 bp, Artificial
  Mutation in BnaC.FAD2.a introduced by TALE nuclease pair BnFAD2_T03
caggatccatgggtgcaggtggaagaatgcaagtctctcctccctccagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31922 - DNA, 433 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggtggcaagcaggcgctggagacggtccagcggctgttgccggtgctgtgccaggcccacggcttgaccccccagcaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31923 - DNA, 351 bp, Artificial
  Mutation in BnaC.FAD2.a introduced by TALE nuclease pair BnFAD2_T03
caggatccatgggtgcaggtggaagaatgcaagtgtatactccctccaagaagtctgaaaccgacaccatcaagcgcgtaccctgcgagacaccgcccttcactgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacctgcgtctgggtcatagcccacgagtgcggccaccacgccttcagcgactac

SEQ ID NO: 31924 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgggacatcatcatagcctcctgcttctactacgtcgccaccacttacttccctctccttcctcaccctctctcctacttcgcctggcctctctactgggcctgccaagggtgcgtcctaaccggcgtctgggtcatagcccacgagtgcggccaccacgccttcagcgactac

SEQ ID NO: 31925 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttaaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31926 - DNA, 331 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31927 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 31928 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccctcaagcgcgtaccctgcgagacaccgcccttcactgagaactcaagaaagcaatcccaccgcactgtttcaaacgctcgatccctcgctctttcccctacctcatctggcacatcatcatagcctcctgcttctactacgtcgccaccacgtacttccctctcctccctcaccctctctcctaccgcgcctggcctctctacggggcctgccaagggtgcgtcctaaccggcgtcggggtcatagctcacgagtgcggccaccacgccttcagcgactac

SEQ ID NO: 31929 - DNA, 421 bp, Artificial
  Mutation in BnaC.FAD2.a introduced by TALE nuclease pair BnFAD2_T03
caggatccatgggtgcaggtggaagaatgcaagtgtcacctccctccaagaagtctgaaaccgacaccatcaagcgcgtaccctgcgagacaccgcccttcactgaccgtctccagcgcctgcttgccggtgctgtgccgccatcgtggctggcgatggccaccacctgctccggggagaactcaagaaagcaatcccaccgcactgtttcaaacgctcgatccctcgctctttctcctacctcatcggggccatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31930 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctgaccggcgtctgggtcatagcccacgagtgcggccaccacgccttcagcgactac

SEQ ID NO: 31931 - DNA, 347 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 31932 - DNA, 413 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgtcgggatgggatccgatccaatgaagacaatcgacatagtgactggatatgttgtgttttacagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31933 - DNA, 332 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31934 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccatcaaacgcgtcccctgcgagacaccaccattcactctacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31935 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31936 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31937 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcttcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31938 - DNA, 340 bp, Artificial
  Mutation in BnaC.FAD2.a introduced by TALE nuclease pair BnFAD2_T03
caggatccatgggtgcaggtggcagaatgcaagtctctcctccctccagctcccccggaaccaacaccctcaaacgcgtcccctgcgagacaccaccattctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31939 - DNA, 344 bp, Artificial
  Mutation in BnaC.FAD2.a introduced by TALE nuclease pair BnFAD2_T03
caggatccatgggtgcaggtggcagaatgcaagtctctcctccctccagctcccccggaaccgacaccatcaagcgcgtaccctgcgagacaccgcccttcagactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31940 - DNA, 319 bp, Artificial
  Mutation in BnaC.FAD2.a introduced by TALE nuclease pair BnFAD2_T03
caggatccatgggtgcaggtgtaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31941 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 31942 - DNA, 319 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgccctccactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31943 - DNA, 340 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgccccctctactggcctgccaagggtgcgtcctaaccggcggctgggtcatagcccacgagtgcggccaccacgccttcagcgactac

SEQ ID NO: 31944 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31945 - DNA, 393 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacacgcctgcttgccgccatcgtggctggcgatggccaccacctgctcctggcacagcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31946 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31947 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31948 - DNA, 349 bp, Artificial
  Mutation in BnaC.FAD2.a introduced by TALE nuclease pair BnFAD2_T03
caggatccatgggtgcaggtggaagaatgcaagtgcctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31949 - DNA, 441 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccaaaaccctcaaacgcgtcccctgcgagacaccacccttcactcttgggctcccccatcgactacggcgtgatcgtggacaccaaggcctactccggcggctacgctatggaactcgccgcccgactgggctggcgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31950 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctactgggcctgccaaggctgcgtcctaacgggcctctgggtcatagcccacgagtgcggccaccacgccttcagcgactac

SEQ ID NO: 31951 - DNA, 355 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcttttggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31952 - DNA, 382 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacagccgctggaccgtctccagcgcctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31953 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31954 - DNA, 349 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 31955 - DNA, 347 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcagagcccacgagggcggccaccacgccttcagcgactac

SEQ ID NO: 31956 - DNA, 348 bp, Artificial
  Mutation in BnaC.FAD2.a introduced by TALE nuclease pair BnFAD2_T03
caggatccatgggtgcaggtagaagaatgcaagtgtctcctccctccaagaagtctgaaaccgacaccatcacgcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaagggtgcgtcctaaccggcgtctggttcatagcccacgagtgcggccaccacgccttcagcgactac

SEQ ID NO: 31957 - DNA, 350 bp, Artificial
  Mutation in BnaC.FAD2.a introduced by TALE nuclease pair BnFAD2_T03
caggatccatgggtgcaggtggaagaatgcaagtatctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31958 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccctcaagaaagcaatcccaccgcactgtttcaaacgctcgatccatcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 31959 - DNA, 349 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgtccaccacgccttcagcgactac

SEQ ID NO: 31960 - DNA, 441 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgcccagtcggcagcgacatccttcggcgcgattttgccggttactgcgctgtaccaaatgcgggacaacgtaagcactacatttcgctcatagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31961 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 31962 - DNA, 287 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31963 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31964 - DNA, 350 bp, Artificial
  Mutation in BnaC.FAD2.a introduced by TALE nuclease pair BnFAD2_T03
caggatcctgggtgcaggtggacgaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31965 - DNA, 346 bp, Artificial
  Mutation in BnaC.FAD2.a introduced by TALE nuclease pair BnFAD2_T03
caggatccatgggtgcagggggaagaatgcaagtgtctcctccctccaagaagtctgaaaacgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacgtacttccctctcctccctcaccctctctcctacttcgcctggcctctctactgggccttccaagggtgcgtcctaaccggcctctgggtcatagcccacgagtgcggccaccgcaccttcagcgactac

SEQ ID NO: 31966 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31967 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacctacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31968 - DNA, 401 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgtccttcacggtccagcggctgttgccgccatcgtggctggcgatggccaccacctgctccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31969 - DNA, 422 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgtggataaccgtattaccgcctttgagtgagctgataccgctcgccgcagccgaacgaccgagcgcagcgagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagtccacgagtgcggccaccacgccttcagcgactac

SEQ ID NO: 31970 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31971 - DNA, 326 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31972 - DNA, 411 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcagccgaacgaccgagcgcagcgagtcagtgagcgaggaagcggaagagcgcccaatacgcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctcgctactgggcctgccaagggtgcgtcctaaccggcgtctgggtcatagcccacgagtgcggccaccacgccttcagcgactac

SEQ ID NO: 31973 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31974 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 31975 - DNA, 351 bp, Artificial
  Mutation in BnaC.FAD2.a introduced by TALE nuclease pair BnFAD2_T03
caggatccatgggtgcaggtggaagaatgaaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31976 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcacgcctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31977 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgccccctgcgagacaccaccattcactcagacctgaagaaagcaatcccaccgcactgtttcaaacgctcgatccctcgctctttctcctacctcatctgtgacatcatcatagcctcctgcttctactacgtcgccaccccttacttccctctcctctctcaccctctctcctcctgcgcctggcctctctactgggcctgccaagggtgcgtcctaaccgacgtctgggtcatagcacacgagggcggccaccacgcctgcagcgactac

SEQ ID NO: 31978 - DNA, 349 bp, Artificial
  Mutation in BnaC.FAD2.a introduced by TALE nuclease pair BnFAD2_T03
caggatccatgggtgcaggtggcagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31979 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31980 - DNA, 348 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31981 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31982 - DNA, 304 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttcaaacgctcgatccctcgctctttctcctacctcatctgggacatcatcatagcctcctgcttctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 31983 - DNA, 409 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcaggcccacggcttgaccccggagcaggtggtggccatcgccagcaatattggtggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31984 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccattaagccacgatggcggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31985 - DNA, 406 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggctggcgatggccaccacctgctggggggtcaagccgtgggcctggcacagcaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31986 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgggtcctaaccggcgtctgggtcatagcccacgagtgcggccaccacgccttcagcgactac

SEQ ID NO: 31987 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctggcctctctactgggcctgccaagggtgcgtcctaacgggcctctgggtcatagcccacgagtgcggccaccacgccttcagcgactac

SEQ ID NO: 31988 - DNA, 352 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31989 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctcaagaaagcaatcccaccgcactgtttcaaacgctcgatccctcgctcgttctcctacctcatctgggacatcatcatagcctcctgcttctactacgtcgccacctcttacttccctctcctccctcaccctctctcctacttcgcctggcctctctactgggcctgccaagggtgcggcctaaccggcgtcggggtcatagcctacgagtgcggccaccacgccttcagcgactac

SEQ ID NO: 31990 - DNA, 309 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31991 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtttggaagcaatcccaccgcactgtttcaaaagctcgatccctcgctctttctcctacctcatctgggacatcatcatagcctcctgcttctactacgtcgccaccacttccttccctctcctccctccccccctctcctacttcccctggcctctctactgagcctgccaagagtgcgtcctaaccggcgtctgggtcatagcccacgagtgcggccaccacgccttcagcgactac

SEQ ID NO: 31992 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31993 - DNA, 382 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagtgcgtaccctgcgagacaccgcccttcactgtacagccgctggaccgtctccagcgcctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31994 - DNA, 349 bp, Artificial
  Mutation in BnaC.FAD2.a introduced by TALE nuclease pair BnFAD2_T03
caggatccatgggtgcaggtggaagaatgcaagtgtctcctccctccagctcccccggaaccaacaccctcaaacgcgtcccctgcgagacaccaccattcactcagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 31995 - DNA, 370 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcaatggcaagcaggcgctggagacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 31996 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 31997 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccgaacccaacaaagcaatcccaccccactgtttcaaacgctcgatcccccgctctttctcctacctcttctgggacatcatcatagcctcctgcttctactacttcgccaccacttacttccccctcctccctccccctctctcctacttcccctggcctctctactgggcctgccaagggtgcggcctaaccggcgtctgggtcatagcccacgagtgcgggccccacgcccttcagcgactac

SEQ ID NO: 31998 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcgtccaccacgccttcagcgactac

SEQ ID NO: 31999 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccctcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctctactgggcctgccaagggtgcgtcctaaccggcgtctgggtcatagcccacgagtgcggccaccacgccttcagcgactac

SEQ ID NO: 32000 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32001 - DNA, 347 bp, Artificial
  Mutation in BnaC.FAD2.a introduced by TALE nuclease pair BnFAD2_T03
caggatccatgggtgcaggtgaaagaatgcaagtgtgtactccctccaagaagtctgaaaccgacaccatcaagcgcgtaccctgcgagacaccgcccttcactgtactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcgcacgagtgcggccaccacgccttcagcaactac

SEQ ID NO: 32002 - DNA, 349 bp, Artificial
  Mutation in BnaC.FAD2.a introduced by TALE nuclease pair BnFAD2_T03
caggatccatgggtgcaggtggaacaatgtaagtgtctcctccctccaagaagtctgaaaccgacaccatcaagcgcgtaccctgcgagacaccgcccttcactgtatcatcaagaaagcaatcccaccgcactgtttcaaacgctcgatccctcgctctttctcctacctcatctgggacatcatcatagcctcctggttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32003 - DNA, 350 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactctagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32004 - DNA, 352 bp, Artificial
  Mutation in BnaC.FAD2.a introduced by TALE nuclease pair BnFAD2_T03
caggatccatgggtgcaggtggaagaatgcaagtgtatcctccctccaagaagtctgaaaccgacaccatcaagcgcgtaccctgcgagacaccgcccttcactgtcgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32005 - DNA, 350 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32006 - DNA, 345 bp, Artificial
  Mutation in BnaC.FAD2.a introduced by TALE nuclease pair BnFAD2_T03
caggatccatgggtgcaggtggaagaatacaagtgtctcctccctccaagaagtctgaaaccgacaccatcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32007 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32008 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagttcggccaccacgccttcagcgactac

SEQ ID NO: 32009 - DNA, 411 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgtacgtgccacacgagtacatcgagctgatcgagatcgcccggaacagcacccaggaccggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcgcctggcctctctactgggcctgccaagggtgcgtcctaaccggcgtctgggtcatagcccacgagtgcggccaccacgccttcagcgactac

SEQ ID NO: 32010 - DNA, 295 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcgctctttctcctacctcatctgggacatcatcatagcctcctgcttctactacgtcgccaccacttacttccctcccctccctcaccctctctcctacttcgcctggcctctctactgggcctgccaagggtgcgtcctaaccggcgtctgggtcatagcccacgagtgcggccaccacgccttcagcgactac

SEQ ID NO: 32011 - DNA, 456 bp, Artificial
  Mutation in BnaC.FAD2.a introduced by TALE nuclease pair BnFAD2_T03
caggatccatgggtgcaggtggaagaatgcaagtgtctcctccctcaaagaagtctgaaaccgacaccacaaagcgcgtaccctgcgagacaccgcccttcactgtaccacctgctggggggtcaagccgtgggcctggcacagcaccggcaacagccgctggaccgtctccagcgcctgcttgccaccattattgctggcgatggccaccaagaactcaagaaagcaatcccaccgcactgtttcaaacgctcgacccctcgctctttctcctacctcaccggggacatcatcatagcctcctgcttctactacgtcgccaccacttccttccctcgccgccctccccctctctccttcttcgcctggcctctctactgggcctgccatggctgcggcctaacgggcctctgggtcatagcccacgagtgcggccaccacgccttcagcgactac

SEQ ID NO: 32012 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccactagtgcggccaccacgccttcagcgactac

SEQ ID NO: 32013 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32014 - DNA, 331 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtaccctgcgagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 32015 - DNA, 436 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacggtccagcggctgttgccggtgctgtgccaggcccacggcttgaccccccagcaggtcgtggccatcgccagcaatggcggcggcacggagaactcaagaaagcaatcccaccgcactgtttcaaacgctcgatccctcgctctttctcctacctcatctgggacatcatcatagccccctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32016 - DNA, 399 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttgggggatcctatcagccgttcccagctggtgaagtccgagctggaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32017 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32018 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32019 - DNA, 436 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagacctttcacgtagtggacaaattcttccaactgatctgcgcgcgaggccaagcgatcttcttcttgtccaagataagcctgtctagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32020 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactggaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactac

SEQ ID NO: 32021 - DNA, 334 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgcttcaaacgctccatcccacgctccttctcctcttcgacatcatcatctcctcctcggctcctccctctaccacctctccacagcctacttccctctcccttacctcgcctgacccctctactgggcctgccaagggtgcgtcctagccggcgtctgggtcatagcccacgagtgcggccaccacgccttcagcgactac

SEQ ID NO: 32022 - DNA, 350 bp, Artificial
  Mutation in BnaC.FAD2.a introduced by TALE nuclease pair BnFAD2_T03
caggatcccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32023 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagaccccgcacttccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctctctactggtcctgcccagggtgcgtcctaaccggcgtctgggtcatagcccccgagggcggccaccacgccagcagcaactac

SEQ ID NO: 32024 - DNA, 350 bp, Artificial
  Mutation in BnaC.FAD2.a introduced by TALE nuclease pair BnFAD2_T03
caggatccatgggtgcaggtggaagaatgcaagtgtctactccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcctctctactgggcctgccaagggtgcgtcctaaccggcgtctgggtcatagcccacgagtgcggccaccacgccttcagcgactac

SEQ ID NO: 32025 - DNA, 356 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgctagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32026 - DNA, 272 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32027 - DNA, 335 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32028 - DNA, 344 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32029 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgttgaactcaagaaagcaatccccccgcactgtttcaaacgctcgatccctcgctctttctcctacctcatctgcgacatcatcatcgcctcctccttctactacgtcgccaccacttacttccccctcctccctcaccctctctcctacttcgcctggcctctctactgggcctgccaagggtgcgtcctaaccggcgtctgggtcatagcccacgagtgcggccaccacgccttcagcgactac

SEQ ID NO: 32030 - DNA, 277 bp, Artificial
  Mutation in BnaC.FAD2.a introduced by TALE nuclease pair BnFAD2_T03
caggatccatgggtgcaggtggaataatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaaccggcgtctgggtcatagcccacgagtgcggccaccacgccttgagcgactac

SEQ ID NO: 32031 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggatcatagcccacgagtgcggccaccacgccttcagcgactac

SEQ ID NO: 32032 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctccgagacaccccccttcactgtaactcaagaaagcaatcccaccgcactgtttcaaacgctcgatccctcgctctttctcctacctcatctgggacaacatcatagcctcctgcttctactacttcgccaccacttacttctctctcctccctcaccctctctcctgcgtcgcctggcctctctactgggcctgcgaagggtgcgtcctcacgggcctcggggtcatagcccacgagtgcggccaccacaccatcagcgactac

SEQ ID NO: 32033 - DNA, 381 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgtgagacaccgcccttcactttcgaggcatttctgtcctggctggtctagaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaggggtgcgtcctaaccggcgtctgggtcatagcccacgagtgcggccaccacgccttcagcgactac

SEQ ID NO: 32034 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32035 - DNA, 351 bp, Artificial
  Mutation in BnaC.FAD2.a introduced by TALE nuclease pair BnFAD2_T03
caggatccatgggtgcaggtggaagaatgcgagtctctcctccctccagctcccccgaaaccaaaaccctcaaacgcgtcccctgcgagacaccacccttcactctgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32036 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtacaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32037 - DNA, 333 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcccttacctcgcctgacccctctactgggcctgccaaggctgcgtcctaacgggcctctgggtcatagcccacgagtgcggccaccacgccttcagcgactac

SEQ ID NO: 32038 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32039 - DNA, 354 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctcgggagacctcaagaaagcaatcccacctcactgcttcaaacgctccatccctcgctccttctcctacctcctctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32040 - DNA, 340 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgttcggctgcggcgagcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32041 - DNA, 354 bp, Artificial
  Mutation in BnaC.FAD2.a introduced by TALE nuclease pair BnFAD2_T03
caggatccatgggtgcaggtggaagaatgcaagtgtctcctccatccaagaagtctgaaaccgacaccatcaagcgcgtaccctgcgagacaccgcccttcactgtcgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32042 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacacgtcccctgcgagacaccacccttcactctgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32043 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatagcctcctgcttctactacgtcgccaccacttacttccctctcctccctcacccgctctcctacttcgcctggcccctctactgggcctgccaagggtgcgtcctaaccggcgtctgggtcatagcccacgagtgcggccaccacgccttcagcgactac

SEQ ID NO: 32044 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacaggcgtctgggtcatagcccacgagtgcggccaccacgccttcagcgactac

SEQ ID NO: 32045 - DNA, 341 bp, Artificial
  Mutation in BnaC.FAD2.a introduced by TALE nuclease pair BnFAD2_T03
caggatccagggtgcaggtggaagaatgcaagtctctcctccctccagctcccccgaaaccaaaaccctcaaacgcgtcccctgcgagacaccacccttcactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32046 - DNA, 350 bp, Artificial
  Mutation in BnaC.FAD2.a introduced by TALE nuclease pair BnFAD2_T03
caggatccatgggtgcaggtgaaagaatgcaagtgtctcctccctccaagaagtctgaaaccgacaccatcaagcgcgtaccctgcgagacaccgcccttcactggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcctggcctctctactgggcctgccatggctgcgtcctaaccggcgtctgggtcatagcccacgagtgcggccaccacgccttcagcgactac

SEQ ID NO: 32047 - DNA, 406 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcggagccgcttgccgccattgctggcgatggccaccacctgctggggggtcaagccgtgggtagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32048 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcatgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32049 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32050 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 32051 - DNA, 345 bp, Artificial
  Mutation in BnaC.FAD2.a introduced by TALE nuclease pair BnFAD2_T03
caggatccatgggtgcaggtggaagaatgcaagtgtctcatccctccaagaagtctgaaaccgacaccatcaagcgcgtaccctgcgagacaccgcccttcactgtacaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccaagggtgcgtcctaaccggcgtctgggtcatagcccacgagtgcggccaccacgccgtcagcgactac

SEQ ID NO: 32052 - DNA, 348 bp, Artificial
  Mutation in BnaC.FAD2.a introduced by TALE nuclease pair BnFAD2_T03
caggatccatgggtgcaggtggaagaatgcaagtctatcctccctccagctcccccgaaaacaaaaccctcaaacgagtcccctgcgagacaccacccttcactcgaccccaagaaagcaatcccaccgcactgtttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32053 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagtgtgcgtcctaaccggcgtctgggtcatagcccacgagtgcggccaccacgccttcagcgactac

SEQ ID NO: 32054 - DNA, 462 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgccataaactgccaggcatcaaactaagcagaaggccatccgtctacagcgcctgcttgccaccgccattgccaggcccacggcttgaccccccagcaggtggtggccattagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32055 - DNA, 414 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgccaacggcttaaccccggagcagggggtggccatcgcaagccacgatggcggcacaagccgctggaagaactcaagaaagcaatcccaccgcactgtttcaaacgcccgatccctcgctcttctcctacctcatcttggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32056 - DNA, 350 bp, Artificial
  Mutation in BnaC.FAD2.a introduced by TALE nuclease pair BnFAD2_T03
caggatccatgggtgcagggcgaagaatgcaagtgtctcctccctccaagaagtctgaaaccgacacaatcaagcacgtaacctgcgagacaccgcccttcactgtagaactcaagaaagcaatcccaccgcactgtttcaaacgctcgatccctcgctctttctcctacctcatctgggacatcatcatagcctcctgcttctactacgtcgcctccacttacttccctctcctccctcaccctctctcctccttcgcctggcctctctactgggcctgccaagggtgcgtcctaaccggcgtctgggtcatagcccacgagtgcggccaccacgccttcagcgactac

SEQ ID NO: 32057 - DNA, 338 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactataacaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32058 - DNA, 348 bp, Artificial
  Mutation in BnaC.FAD2.a introduced by TALE nuclease pair BnFAD2_T03
caggatccatgggtgcaggtggaagaatgcaagtgtctcctccctcccaaaagcctgaaaccgacaccctcaagcgcgtaccctgcgagacaccgcccttcactagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32059 - DNA, 465 bp, Artificial
  Mutation in BnaC.FAD2.a introduced by TALE nuclease pair BnFAD2_T03
caggatccatgggtgcaggtggaagaatgcaagtctctcctccctccaagaagcctgaaaccgacaccatcaagcgcgtaccctgcgagacaccgcccttcactgtcggaccgagatagggttgagtgttgttccagtttggaacaagagtccactattaaagaacgtggactccaacgtcaaagggcgaaaaaccgtctatcagggcgatggttcacgtgagaactcaagaaagcaatcccaccgcactgttccaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32060 - DNA, 409 bp, Artificial
  Mutation in BnaC.FAD2.a introduced by TALE nuclease pair BnFAD2_T03
caggatccatgggtgcaggtgcaagaatgcaagtgtctcctccctccaagaagtctgaaaccgacaccatcaagcgcgtaccctgcgagacaccgcccttcactgtcaggcccacggcttgaccccggagcaggtggtggccatcgccagcaatattggtggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32061 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 32062 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcacatgagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32063 - DNA, 409 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggccagttaccttcggaaaaagagttggtagctcttgatccggcaaacaaaccaccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32064 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacttagaactcaagaaagcaatcccaccgcactgtttcaaacgctcgatccctcgctctttctcctacctcatctgggacatcatcatagcctcctgcttctactacgtcgccatcacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32065 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaccgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32066 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccctcactagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32067 - DNA, 354 bp, Artificial
  Mutation in BnaC.FAD2.a introduced by TALE nuclease pair BnFAD2_T03
caggatccatgggtgcaggtggaagaatgcaagtctctcctcccttcagctcccccgaaaccaaaaccctcaaacgcgtcccctgcgagacaccacccttcactctcgggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacctggcctctctactgggcctgccaagggtgcgtcctaaccggcgtctgggtcatagcccacgagtgcggccaccacgccttcagcgactac

SEQ ID NO: 32068 - DNA, 319 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtttcaaacgctcgatccctcgctctttctcctacctcatctgggacatcatcatagcctcctgcttctactacgtcgccaccacttacttccctctcctccctcaccatctctcctacttcgcctggcctctctactgggcctgccaagggtgcgtcctaaccggcgtctgggtcatagcccacgagtgcggccaccacgccttcagcgactac

SEQ ID NO: 32069 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcatcgactacc

SEQ ID NO: 32070 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactgc

SEQ ID NO: 32071 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccatcagcgactac

SEQ ID NO: 32072 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32073 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaacgcgtcccctgcgagacaccaccaagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32074 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagcctgaaaccgacaccatcaagcgcgtaccctgcgagacaccgcccttcactgagacctcaagaaagcaatcccaccgcactgtttcaaacgctcgatccctcgctccttctcctacctcatctgcgacatcatcatagcctcctgcttctactacgtcgccaccgcttacttccctctcctccctcaccctctctcctacctcgcctggcccctctactgggcctgccaaggctgcgtcctaaccggcctctgggtcatagcccacgagtgcggccaccacgccttcagcgactac

SEQ ID NO: 32075 - DNA, 349 bp, Artificial
  Mutation in BnaC.FAD2.a introduced by TALE nuclease pair BnFAD2_T03
caggatccatgggtgcaggtggaagaatgcaagtctctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32076 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcgacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32077 - DNA, 280 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgggacatcatcatagcctcctgcttctactacgtcgccaccacttacttccctctcctccctcaccctctctcctacttcgcctggcctctctactgggcctgccaaggctgcgtcctaacgggcctctgggtcatagcccacgagtgcggccaccacgccttcagcgactac

SEQ ID NO: 32078 - DNA, 377 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtggggttccgatttagtgctttacggggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32079 - DNA, 319 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccacccttcactgtttcaaacgctagatccctcgctctttcttctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32080 - DNA, 342 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 32081 - DNA, 343 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32082 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaacctacaacatcaagcgcgtaccctgcgagacaccgcccttcactgactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32083 - DNA, 327 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttccccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32084 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatcgcccacgaatgcggccaccacgccttcagcgactac

SEQ ID NO: 32085 - DNA, 436 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgggcttgaccccccagcaggtggaggccatcgccagcaataatggtggcaagcaggcgctggagacggtccagcggctgttgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32086 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcgcgactac

SEQ ID NO: 32087 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccgagggtgcgtcctaaccggcgtctgggtcatagcccacgagtgcggccaccacgccttcagcgactac

SEQ ID NO: 32088 - DNA, 419 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggcccacggcttgaccccccagcaggtggtggccatcgccagcaataatggtggcaagcaggcgctggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgcctggcctctctactgggcctgccaagggtgcgtcctaaccggcgtctgggtcatagcccacgagtgcgaccaccacgccttcagcgactac

SEQ ID NO: 32089 - DNA, 357 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtttttgttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgtggccaccacgccttcagcgactac

SEQ ID NO: 32090 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcgcctggcctctctactgggcctgccaagggtgcgtcctaaccggcgtctgggtcatagcccacgagtgcggccaccacgccttcagcgactac

SEQ ID NO: 32091 - DNA, 465 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccgcccttcactgtcggaccgagatagggttgagtgttgttccagtttggaacaagagtccactattaaagaacgtggactccaacgtcaaagggcgaaaaaccgtctatcagggcgatggttcacgtgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32092 - DNA, 300 bp, Artificial
  Mutation in BnaC.FAD2.a introduced by TALE nuclease pair BnFAD2_T03
caggatccatgggtgcaggtcgaagaatgcaagtctatcctccctccagctcccccgaaaccaaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32093 - DNA, 350 bp, Artificial
  Mutation in BnaC.FAD2.a introduced by TALE nuclease pair BnFAD2_T03
caggatccatgggtgcaggtggaagaatgcaagtgtatccaccctccaagaagtctgaaaccgacaccatcaagcgcgtaccctgcgagacaccgcccttcactgtaaaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32094 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacacaatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32095 - DNA, 356 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcggcctaaccggcgtctgggtcatagcccacgagtgcggccaccacgccttcagcgactac

SEQ ID NO: 32096 - DNA, 349 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactcagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32097 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaagcgcgtaccctgcgagacaccgcccttcacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32098 - DNA, 305 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgaatgcggccaccacgccttcagcgactac

SEQ ID NO: 32099 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32100 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggttgcgtcctaaccggcgtctgggtcatagcccacgagtgcggccaccacgccttcagcgactac

SEQ ID NO: 32101 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgctctctcgctctttctcctacctcatctgtgacatcatcatagcctcctgcttctactacgtcgccaccacttacttccctctccgccctcaccctctctcctgcttcacctggcctctctacggggcctgccaagggtgcgtcctaaccggcgtctgggtcatagcccacgagtgcggccaccacgccttcagcgactac

SEQ ID NO: 32102 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatatcccacgagtgcggccaccacgccttcagcgactac

SEQ ID NO: 32103 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactttagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32104 - DNA, 344 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcaccctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatcgcccacgaatgcggccaccacgccttcagcgactac

SEQ ID NO: 32105 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctggttcatagcccacgagtgcggccaccacgccttcagcgactac

SEQ ID NO: 32106 - DNA, 436 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagacctttcacgtagtggacaaattcttccaactgatctgcgcgcgaggccaagcgatcttcttcttgtccaagataagcctgtctagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32107 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaagggtgcgtcctaacgggcctctgggtcatcgcccacgaatgcggccaccacgccttcagcgactac

SEQ ID NO: 32108 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32109 - DNA, 336 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagctactac

SEQ ID NO: 32110 - DNA, 346 bp, Artificial
  Mutation in BnaC.FAD2.a introduced by TALE nuclease pair BnFAD2_T03
caggatccatgggtgcaggtgggagaatgcaagtgtctcctccctccaagaagtctgaaaccgacaccatcaagcgcgtaccctgcgagacaccgcccttcactaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32111 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatcgcccacgaatgcggccaccacgccttcagcgactac

SEQ ID NO: 32112 - DNA, 417 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcgtgggcctggcacagcaccggcaacagccgctggaccgtctccagcgcctgcttgccaccgccattagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32113 - DNA, 420 bp, Artificial
  Mutation in BnaC.FAD2.a introduced by TALE nuclease pair BnFAD2_T03
caggatccatgggtgcaagtggaagaatgcaagtgtctcctccctccaagaagactgaaaccgacaccatcaagcgcgtaccctgcgagacaccgcccttcactgtcaggcccacggcttgaccccggagcaggtggtggccatcgccagccacgatggcggcaacagccgctggaagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32114 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaactcaagaaagcaatcccaccgcactgtttcaaacgctcgatccctcgctctttctcctacctcatctgggacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgactac

SEQ ID NO: 32115 - DNA, 374 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaactccagaaacccgcggctgagtggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 32116 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcgtctgggtcatagcccacgagtgcggccaccacgccttcagcgactac

SEQ ID NO: 32117 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcccctctactgggcctgccaaggctgcgtcctaacgggcctctgggtcatagcccacgagtgcggccaccacgccttcagcgactac

SEQ ID NO: 32118 - DNA, 278 bp, Artificial
  Mutation in BnaC.FAD2.a introduced by TALE nuclease pair BnFAD2_T03
caggatccatgggtggcaggtggaagaatgcaagtgtctcctccctccaagaagtctgaaaccgacaccatcaagcgcgtaccctgcgagacaccgcccttcactgtcgatcgagcgtttgaaacagtgcggtgggattgctttcttgagttctccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32119 - DNA, 342 bp, Artificial
  Mutation in BnaC.FAD2.a introduced by TALE nuclease pair BnFAD2_T03
caggatccatgagtgcaggtggaagaatgcaagtgactcctccctccaagaagtctgaaaccgacaccatcaagcgcgtaccctgcgagacaccgcccttcactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32120 - DNA, 346 bp, Artificial
  Mutation in BnaC.FAD2.a introduced by TALE nuclease pair BnFAD2_T03
caggatccatgggtgcaggtggaagaatgcaagtgtctcctccctccaagtcgcctgaaaccgacaccatcaagcgcgtaccctgcgagacaccgcccttcactaactcaagcaagcaatcccaccccactgtttcaaactctcaatccctcgctctttctcctacctcatctgggacatcatcatagcctcctgcttctactacgtcgccaccacctacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32121 - DNA, 277 bp, Artificial
  Mutation in BnaC.FAD2.a introduced by TALE nuclease pair BnFAD2_T03
caggatccatgggtgcaggtggaagaatgcaagtgtctcctccctccaagaagtccgaaaccgacaccatcaagcgcgtaccctgcgagacaccgcccttcactgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32122 - DNA, 279 bp, Artificial
  Mutation in BnaC.FAD2.a introduced by TALE nuclease pair BnFAD2_T03
caggatccatgggtgcaggtggaagaatgcaagtctctcctccctccagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32123 - DNA, 360 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaacatcaagcgcgtaccctgcgagacaccgcccttcactgtcgcgacgcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32124 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgagagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaacgggcctctgggtcatagcccacgagtgcggccaccacgccttcagcgactac

SEQ ID NO: 32125 - DNA, 415 bp, Artificial
  Mutation in BnaC.FAD2.a introduced by TALE nuclease pair BnFAD2_T03
caggatccatgggtgcaggtggaagaatgcaagtctctcctccctcccgctcccccggaaccaacaccctcaaacgcgtcccctgcgagacaccaccattcactcttggccaccacctgctgaggggtcaagccgtgggcctggcacagcaccggcaacagccgctggaggagacctcaagaaagcaatcccaccgcactgtttcaaacgctcgatccctcgctctttctcctacctcatctgggacatcatcatagcctcctgcttctactacgtcgccaccacttacttccctctccgccctcaccctctcgccttcttcgccaggcccctctactgggcctgccaaggctgcggcctaacgggccactgtgtcatcgcccgcgaatgcggccaccacgccttcagcgactac

SEQ ID NO: 32126 - DNA, 343 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32127 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctccttctcctacctcctcttcgacatcctcgtctcctcctccctctaccacctctccacagcctacttccctctcctcccccaccctctctcctacttcgcctggcctctctactgggcctgccaaggctgcgtcctaacgggcctctgggtcatcgcccacgaatgcggccaccacgccttcagcgactac

SEQ ID NO: 32128 - DNA, 348 bp, Artificial
  Mutation in BnaC.FAD2.a introduced by TALE nuclease pair BnFAD2_T03
caggatccatgggtgcaggtggaagaatgcaagtgtctcctccctcccagaagtctgaaaccgacaccatcaagcgcgtaccctgcgagacaccgcccttcacgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaatggtgcgtcctaaccggcgtctgggtcatagcccacgagtgcggccaccacgccttcagcgactac

SEQ ID NO: 32129 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaaacgcgtaccctgcgagacaccgcccttcactttgctccaagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32130 - DNA, 408 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggacttcgctgctacccaaggttgccgggtgacgcacaccgtggaaacggatgaaggagaactcaagaaagcaatcccaccgcactgtttcaaacgctcgatccctcgctctttctcctacctcatctgggacatcatcatagcctcctgcttctactacgtcgccaccacttacttccctctccgccctcaccctctctcctacttcgcctggcctctctactgggcctgccaagggtgcgtcctaaccggcgtctgggtcatagcccacgagtgcggccaccacgccttcagcgactac

SEQ ID NO: 32131 - DNA, 345 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccctggcgacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32132 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagactgaaaccgacaccatcaagcgcgtaccctgcgagacaccgcccttcatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32133 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32134 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32135 - DNA, 347 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcacagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32136 - DNA, 348 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacactgcccttcactgtaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgcctggcccctctacggggcctgccaaggctgcgtcctaacgggcctctgggtcatcgcccacgaatgcggccaccacgccttcagcgactac

SEQ ID NO: 32137 - DNA, 305 bp, Artificial
  Mutation in BnaC.FAD2.a introduced by TALE nuclease pair BnFAD2_T03
caggatccatgggtgcaggtgtaagaatgcaagtggctcctccatccaagaagtctgaaaccgaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatcgcccacgaatgcggccaccacgccttcagcgactac

SEQ ID NO: 32138 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32139 - DNA, 350 bp, Artificial
  Mutation in BnaC.FAD2.a introduced by TALE nuclease pair BnFAD2_T03
caggatccatgggtgcaggtggaagaatgcaagtctctcctccctccagctcccccggaaccaaaaccctcaaacgcgtcccctgcgagacaccaccattcactctaggcctcaagaaaacaatcaccccgccctgttgcaaccgctcgatccctcgctctttcttctacctcatctgggacatcatcatagcatcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32140 - DNA, 344 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 32141 - DNA, 394 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaagcgcgtaccctgcgagacaccgcccttcactgtctcgaccctcaatgattttattttgcctcattgctacctgttcgcgaactcaagcaagcaatcccaccgcactgtttcaaacgctcgatccctcgctctttctcctacctcatctgggacatcatcatagcctcctgcttctactacgtcgccaccacctacttccctctcccccctcaccctctcccttacctcgcctggcccctctactgggcctgccaaggctgcgtcctaaccggcgtctgggtcatagcccacgagtgcggccaccacgccttcagcgactac

SEQ ID NO: 32142 - DNA, 348 bp, Artificial
  Mutation in BnaC.FAD2.a introduced by TALE nuclease pair BnFAD2_T03
caggatcaatgggtgcaggtggaagaatgcaagtgtctcctccctccagctcccccggaaccaacaccctcaaacgcgtcccctgcgagacaccgcccttcactgtaactcaagaaagcaatcccaccgcactgtttcaaacgctagatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32143 - DNA, 345 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgacccctctaatgggcctgccaaggctgcgtcctaacgggcctctgggtcatagcccacgagtgcggccaccacgccttcagcgactac

SEQ ID NO: 32144 - DNA, 342 bp, Artificial
  Mutation in BnaC.FAD2.a introduced by TALE nuclease pair BnFAD2_T03
caggatccatgggtgcaggtggaagaatgtaagtgtctcctccctccaagaagtctgaaaccgacaccatcaagcgcgtaccctgcgagacaccgcccttaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32145 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacactggagacggtctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32146 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcctctgggtcatagcccacgagtgcggccaccacgccttcagcgactac

SEQ ID NO: 32147 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtactcaaggaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32148 - DNA, 435 bp, Artificial
  Mutation in BnaC.FAD2.a introduced by TALE nuclease pair BnFAD2_T03
caggatccatggtgcaggtggaagaatgcaagtgtctcctccctccaagaagtctgaaaccgacaccatcaagcgcgtaccctgcgagacaccgcccttcacggtccagcggctgttgccggtgctgtgccaggcccacggcttgaccccccagcaggtggtggccatcgccagcaatggcggtggcacggagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32149 - DNA, 348 bp, Artificial
  Mutation in BnaC.FAD2.a introduced by TALE nuclease pair BnFAD2_T03
caggatccatgggtgcagggggaagaatgcaagtgtctcctccctccaagaagtctgaaaccgacaccatcaagcgcgtaccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32150 - DNA, 314 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccacctcactgcttcaaacgctccatcccacgctccttctcctcttcgacatcatcatctcctcctcggctcctccctcaccctctctcctacttcgcctggcctctctactgggcctgccaagggtgcgtcctaaccggcgtctgggtcatagcccacgagtgcggccaccacgccttcagcgactac

SEQ ID NO: 32151 - DNA, 326 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32152 - DNA, 352 bp, Artificial
  Mutation in BnaC.FAD2.a introduced by TALE nuclease pair BnFAD2_T03
caggatccgtgggtgcagggggaagaatgcaagtgtgtcttccttccaagaagtctgaaaccgacaccatcaagcgcgtaacctgtgcgacaccgcccttcactgtggagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctcgcctgacccctctactgggcctgccaagagtgcttcctaaccggcgtctgggtcataacccaccagtgctgccaccacgccttccgcgactac

SEQ ID NO: 32153 - DNA, 351 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtgagaactcaagaaagcaatcccaccgcactgtttcaaacgctcgatccctcgctctttctcctacctcatctgggacatcatcatagcctcctgcttctactacgtcgcctccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32154 - DNA, 382 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaacaccatcaacatcgtggctggcgatggccaccacctgtgccaggcccacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32155 - DNA, 349 bp, Artificial
  Mutation in BnaC.FAD2.a introduced by TALE nuclease pair BnFAD2_T03
caggatccatgggtgcaggtggaagaatgcaagtgtctcctccctccagctcccccgaaaccaaaaccctcaaacgcgtcccctgcgagacaccacccttcactgagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32156 - DNA, 347 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgaactcaagaaagtaatcccaccgcactgtttcaaacgctctatctcttgctctttctcctacctcatctgggaccccatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcaacgactac

SEQ ID NO: 32157 - DNA, 340 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgccctactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32158 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactcgacctcaagaaagcaatcccaccgcactgtttcaaacgctcgatccctcgctctttctcctacctcatctgggacatcatcatagcctcctgcttctactacgtcaccaccacttacttccctctcctccctcaccctctctcctacctcgcctggcctctctactgggcctgccaaggctgcgtcctaaccggcgtctgggtcatagcccacgaatgcggccaccacgccttcagcgactac

SEQ ID NO: 32159 - DNA, 350 bp, Artificial
  Mutation in BnaC.FAD2.a introduced by TALE nuclease pair BnFAD2_T03
caggatccatgggtgcatgtggaagaatgcaagtgtctcctccctccaagaagtctgaaaccgacaccatcaagcgcgtaccctgcgagacaccgcccttcactgtaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32160 - DNA, 350 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctggcccctctactgggcctgccaaggctgcgtcctaacgggcgtctgggtcatagcccacgagtgcggccaccacgccttcagcgactac

SEQ ID NO: 32161 - DNA, 351 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaaaaccctcaaacgcgtcccctgcgagacaccacccttcactctgagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32162 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccgcgagtgcggccaccacgccttcagcgactac

SEQ ID NO: 32163 - DNA, 343 bp, Artificial
  Mutation in BnaC.FAD2.a introduced by TALE nuclease pair BnFAD2_T03
caggatccatgggtgcaggtggaagaatgcaagtctctcctccctccagctcccccggaaccaacaccctcaaacgcgtcccctgcgagacaccaccattcactccagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32164 - DNA, 355 bp, Artificial
  Mutation in BnaC.FAD2.a introduced by TALE nuclease pair BnFAD2_T03
caggatccatgggtgcaggtggaagaatgcaagtgtctcctccctccaagaagactgaaaccgacaccctcaagcgcgtaccctgcgagacaccgcccttcaatggcaagcaggcgctggagacggagaactcaagaaagcaatcccaccgcactgtttcaaacgctcgatccctcgctctttctcctacctcatctgggacaccatcatagcctcctgcttctactacgtcgccaccacttacttccctctcccttacctcgcctggcccctctactgggcctgccaaggctgcgtcctaacgggcctctgggtcatagcccacgagtgcggccaccacgccttcagcgactac

SEQ ID NO: 32165 - DNA, 341 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaaggctgcgtcctaacgggcctctgggtcatcgcccacgaatgcggccaccacgccttcagcgactac

SEQ ID NO: 32166 - DNA, 308 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagaaagcaatcccaccgcactgtttcaaacgctcgatccctcgctctttctcctacctcatctgggacatcatcatagcctcctgcttctactacgtcgccaccacttacttccctctcctccctcaccctttctcctacttcgcctggcctctctactgggcctgccaagggtgcgtcctaaccggcgtctgggtcatagcccacgagtgcggccaccacgccttcagcgactac

SEQ ID NO: 32167 - DNA, 348 bp, Artificial
  Mutation in BnaC.FAD2.a introduced by TALE nuclease pair BnFAD2_T03
caggatccatgggtgcaggtggaagaatgcaagtctctcctccctccagctcccccgaaaccaacaccctcaaacgcgtcccctgcgagacaccgcccttcactgtaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32168 - DNA, 371 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtaaactcaagaaagcaatcccaccgcactgtttcaaccgctcgatccctcgctctttctcctacctcatctgggacatcatcatagcctcctgcttctactacgtcgccaccacttacttccctctcctccatctaccacctctccacagcctccttccctctcccttacctcgcctgacccctctactgggcctgccaaggctgcgtcctaacgggcctctgggtcatagcccacgagtgcggccaccacgccttcagcgactac

SEQ ID NO: 32169 - DNA, 342 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactcaagaaagcaatcccaccgcactgtttcaaacgctcgatcactcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32170 - DNA, 349 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgtgtcctaaccggcgtctgggtcatagcccacgagtgcggccaccacgccttcagcgactac

SEQ ID NO: 32171 - DNA, 344 bp, Artificial
  Mutation in BnaC.FAD2.a introduced by TALE nuclease pair BnFAD2_T03
caggatccatgggcgcaggtggaagaatgcaagtgtctcctcccttcaagaagtctgaaaccgacaccatcaagcgcgtaccctgcgagacaccgcccttcacactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagagtgcgtcctaaccggcgtctgggtcatagcccacgagtgcggccaccacgccttcagcgactac

SEQ ID NO: 32172 - DNA, 356 bp, Artificial
  Mutation in BnaC.FAD2.a introduced by TALE nuclease pair BnFAD2_T03
caggatccatgggtgcaggtggaagaatgcaagtgtctcctccctccaagaagtctgaaaccgacaccatcaagcgcgtaccctgcgagacaccgcccttcactgtcggcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgcctggcccctctactgggcctgccaaggctgcgtcctaacgggcctctgggtcatcgcccacgaatgcggccaccacgccttcagcgactac

SEQ ID NO: 32173 - DNA, 348 bp, Artificial
  Mutation in BnaC.FAD2.a introduced by TALE nuclease pair BnFAD2_T03
caggatccatgggtgcaggtggaagaatgcaagtgtctcctccctccaaaaagtctgaaaccgacaccatcaagcgcgtaccctgcgagacaccgcccttcactgaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactac

SEQ ID NO: 32174 - DNA, 283 bp, Artificial
  Mutation in BnaC.FAD2.a introduced by TALE nuclease pair BnFAD2_T03
caggatccatgggtgcaggtggaagaatgcaagtgactcctccctcaagaaagcaatcccaccgcactgtttcaaacactcgatccctcgctctttctcctacctcatctgggacatcatcatagcctcctgcttctactacgtcgccaccacttacttccctctcctccctcaccctctctcctacttcgcctggcctctctactgggcctgccaagggttcgtcctaaccggcgtctgggtcatagcccacgagtgcggccaccacgccttcagcaactac
